(12) United States Patent
Liu et al.

(10) Patent No.: US 12,157,769 B2
(45) Date of Patent: *Dec. 3, 2024

(54) VIRUS COMPOSITION

(71) Applicant: BINHUI BIOPHARMACEUTICAL CO., LTD., Wuhan (CN)

(72) Inventors: Binlei Liu, Wuhan (CN); Linkang Cai, Wuhan (CN); Runyang Wang, Wuhan (CN); Siqi Zhang, Wuhan (CN); Han Hu, Wuhan (CN)

(73) Assignee: BINHUI BIOPHARMACEUTICAL CO., LTD., Wuhan (CN)

( * ) Notice: Subject to any disclaimer, the term of this patent is extended or adjusted under 35 U.S.C. 154(b) by 37 days.

This patent is subject to a terminal disclaimer.

(21) Appl. No.: 18/047,285

(22) Filed: Oct. 18, 2022

(65) Prior Publication Data

US 2023/0192852 A1     Jun. 22, 2023

Related U.S. Application Data

(63) Continuation of application No. 17/568,738, filed on Jan. 5, 2022, now Pat. No. 11,505,607, which is a continuation of application No. PCT/CN2021/130773, filed on Nov. 15, 2021.

(30) Foreign Application Priority Data

Nov. 13, 2020 (CN) .......................... 202011265931.6

(51) Int. Cl.
*C12N 7/00*     (2006.01)
*C07K 16/28*     (2006.01)

(52) U.S. Cl.
CPC ...... *C07K 16/2809* (2013.01); *C07K 16/2827* (2013.01); *C12N 7/00* (2013.01); *C07K 2317/31* (2013.01); *C07K 2317/622* (2013.01); *C12N 2710/16621* (2013.01); *C12N 2710/16632* (2013.01); *C12N 2710/16643* (2013.01)

(58) Field of Classification Search
CPC .................................................. C07K 16/2809
USPC ....................................................... 424/136.1
See application file for complete search history.

(56) References Cited

U.S. PATENT DOCUMENTS 11,505,607 B2 * 11/2022 Liu .................... C07K 16/2827

\* cited by examiner

*Primary Examiner* — Sean E Aeder
(74) *Attorney, Agent, or Firm* — Jeenam Park

(57) ABSTRACT

The present disclosure provides a virus composition. The efficacy of a variety of virus compositions loaded with different functional genes was detected, and several virus compositions with excellent antitumor effect were confirmed.

3 Claims, 11 Drawing Sheets

Specification includes a Sequence Listing.

VIRUS COMPOSITION

CROSS REFERENCE OF RELATED APPLICATIONS

This application is a Continuation-in-Part Application of my application U.S. Ser. No. 17/568,738 filed on Jan. 5, 2022, which is a Continuation-Application of NO. PCT/CN2021/130773 filed on Nov. 15, 2021. This PCT also claims priority foreign priority of Chinese Patent Application No. 202011265931.6, filed on Nov. 13, 2020, the entire content of which is incorporated herein by reference.

SEQUENCE LISTING

The instant application contains a Sequence Listing which has been submitted electronically in ST.26 format and is hereby incorporated by reference in its entirety. Said ST.26 copy, created on Oct. 14, 2022, is named Binhui221014.xml and is 1,277,448 bytes in size.

TECHNICAL FIELD

The present disclosure relates to the field of biotechnology, in particular to a bispecific single-chain antibody, recombinant oncolytic virus for expressing same and virus composition.

BACKGROUND

BsAb (bispecific T cell engagers) is a bispecific single-chain antibody taking T cells as effector cells, has two antigen binding arms, can be simultaneously bound with the T cells and target cells, and can activate cytotoxic T cells to kill diseased cells. Compared with other bispecific antibodies, the BsAb has better molecular flexibility, can better promote the connection of a CD3 complex and a tumor target, is not restricted by a T cell receptor and MHC class I molecules on target cells, does not need the participation of costimulatory molecules, and is an antibody form with great application potential.

Herpes simplex virus (HSV) is a double stranded DNA virus with a length of about 154 kb, which can replicate in the infected host nucleus. HSV vector has the following advantages: 1) wide host cells; 2) high virus titer; 3) large foreign gene capacity. The disadvantage of HSV vector is its toxicity.

The prior art provides a variety of recombinant oncolytic viruses loaded with different functional genes with HSV type II as the vector.

SUMMARY

The present disclosure aims to provide a bispecific single-chain antibody, recombinant oncolytic virus for expressing same and virus composition.

In order to achieve the purpose, one aspect of the disclosure is directed to a bispecific single-chain antibody. The bispecific single-chain antibody, comprising a CD3 binding site and a PD-L1 binding site, and is called BsAb-PD-L1 for short.

In some embodiments of the present disclosure, the amino acid sequence of the bispecific single-chain antibody is as shown in SEQ ID No.1.

The second aspect of the present disclosure is directed to an application of the bispecific single-chain antibody in preparation of antitumor drugs. The BsAb-PD-L1 provided by the present disclosure is a bispecific antibody capable of simultaneously binding CD3 and PD-L1 on the surfaces of tumor cells, and when the BsAb-PD-L1 enters a body and is bound with the T cells, the T cells can be effectively activated, and the T cells are guided to kill the tumor cells. When BsAb-PD-L1 is bound with the tumor cells, the tumor cells can be exposed, the T cells are attracted to kill the tumor cells, meanwhile, immunosuppression of PD-1/PD-L1 can be relieved, and depletion of the T cells is delayed.

The third aspect of the present disclosure is directed to a recombinant oncolytic virus carrying a gene of the bispecific single-chain antibody, the recombinant oncolytic virus includes a herpes simplex virus type II as a vector, and a coding gene of the bispecific single-chain antibody is integrated in the vector, it is named oHSV2-BsAb-PD-L1.

In some embodiments of the present disclosure, the recombinant oncolytic virus is a herpes simplex virus type II HG52dICP47d34.5-BsAb-PDL-1, and its accession number is CCTCC (China Center for Type Culture Collection) NO: V202053. It is preserved in China Center for Type Culture Collection in Wuhan University on Sep. 8, 2020.

The vector is a recombinant herpes simplex virus type II with ICP 34.5 region and ICP 47 region knocked out, and a BsAb-PD-L1 gene is integrated into the knocked-out ICP 34.5 region by utilizing a plasmid pHG52d34.5-CMV-BsAb-PD-L1 in a homologous recombination manner (On the premise of knowing the BsAb-pd-l1 sequence, those skilled in the art can easily construct the vector plasmid). Because the bispecific single-chain antibody gene is integrated into the oncolytic virus, the bispecific single-chain antibody can be expressed in vivo for a long time, and the longest expression can reach 7 days.

The fourth aspect of the present disclosure is directed to a virus composition, comprising two or more recombinant herpes simplex viruses loaded with different functional genes, one of the virus is oHSV2-BsAb-PD-L1.

In some embodiments of the present disclosure, the virus composition also includes one or more selected from the group consisting of oHSV2-hGM-CSF, oHSV2-OX40L, oHSV2-PD1v, oHSV2-neo and oHSV2-IL12. Preferably, the virus composition is oHSV2-BsAb-PD-L1 and oHSV2-hGM-CSF. Specifically, oHSV2-hGM-CSF is preserved, and its accession number is CGMCC no. 3600; More preferably, the virus composition is oHSV2-BsAb-PD-L1, oHSV2-hGM-CSF and oHSV2-OX40L.

The fifth aspect of the present disclosure is directed to a virus composition, comprising oHSV2-hGM-CSF and oHSV2-OX40L, oHSV2-hGM-CSF is a herpes simplex virus type II loaded with the gene encoding Human Granulocyte-Macrophage Colony Stimulating Factor, oHSV2-OX40L is a herpes simplex virus type II loaded with the gene encoding OX40L protein. In some embodiments of the present disclosure, the virus composition also includes one or more selected from the group consisting of oHSV2-PD1v, oHSV2-neo and oHSV2-IL12. oHSV2-PD1v is a herpes simplex virus type II loaded with a gene encoding PD1v protein comprising the amino acid sequence of SEQ ID No: 6; oHSV2-neo is a herpes simplex virus type II loaded with a gene encoding neo protein comprising the amino acid sequence of SEQ ID No: 4; oHSV2-IL12 is a herpes simplex virus type II loaded with a gene encoding IL12.

The sixth aspect of the present disclosure is directed to a virus composition, comprising oHSV2-PD1v, oHSV2-neo and oHSV2-IL12.

In some embodiments of the present disclosure, the herpes simplex virus type II mentioned above is herpes simplex virus type II HG52 strain, and the ICP34.5 and ICP47 of the HG52 strain is eliminated; then the loaded gene was inserted into ICP 34.5 sites.

The beneficial effects of the present disclosure are as follows:
1. BsAb-PD-L1 can effectively activate T cells and guide T cells to kill tumor cells.
2. oHSV2-BsAb-PD-L1 can specifically proliferate in the tumor cells, the oncolytic virus has the characteristics of high safety and simple preparation process, the half-life period of the BsAb-PD-L1 in an organism is prolonged, and the administration frequency and the administration dosage are reduced.
3. The efficacy of a variety of virus compositions loaded with different functional genes was detected, and several virus compositions with excellent antitumor effect were confirmed.

DETAILED DESCRIPTION OF THE EMBODIMENTS

The present disclosure is further described in detail in combination with drawings and specific embodiments. The following embodiments are implemented on the premise of the technical solution, a detailed implementation mode and a specific operation process are provided, but the protection range of the present disclosure is not limited to the following embodiments.

Part I BsAb-PD-L1 and oHSV2-BsAb-PD-L1

Embodiment 1

A Process of BsAb-PD-L1 Preparation

A pHG52d34.5-CMV-BsAb-PD-L1 plasmid is transfected into HEK-293T by using a calcium phosphate transfection reagent, supernatants are collected after 48 hours and 72 hours, and BsAb-PD-L1 in the supernatants is adsorbed by using a Ni-NTA affinity chromatography medium (AKTA); a washing buffer solution (50 mM of $Na_2HPO_4$, 0.3 M of NaCl and 10 mM of imidazole with a pH value of 8.0) and an elution buffer solution (50 mM of $Na_2HPO_4$, 0.3 M of NaCl and 250 mM of imidazole with a pH value of 8.0) are used for eluting the BsAb-PD-L1 from the medium; and the obtained product is dialyzed by using a 20 kDa dialysis card, the dialyzed product is replaced in a PBS buffer solution, and the dialyzed product is cryopreserved at −70° C.

Embodiment 2

Figure 1:
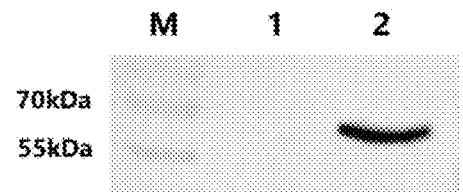
FIG. 1 is an electrophoresis purification diagram of BsAb-PD-L1.

BsAb-PD-L1 Western Identification
1) a collected protein sample is uniformly mixed with a 4×SDS-PAGE protein loading buffer solution, and the obtained mixture is boiled for 10 minutes;
(2) SDS-PAGE gel and 12% separation gel are prepared, 5 μL of a protein Marker and 6 μL of a sample are respectively added into a sample application hole, electrophoresis is started, the voltage of the upper layer gel is controlled to be 80V and the voltage of the lower layer gel is controlled to be 120V, and electrophoresis is stopped when bromophenol blue reaches the bottom; the result is as shown in FIG. 1, a first lane is a negative control sample, and a second lane is a BsAb-PD-L1 sample (55 kDa);
3) after the electrophoresis is finished, gel cutting is carried out to remove upper-layer gel and redundant gel, and meanwhile, the bromophenol blue part at the bottom end is cut off;
4) filter paper and an NC (nitrocellulose) membrane are cut, the size of the NC membrane is enabled to be equal to that of the gel, small filter paper is enabled to be slightly smaller than that of the gel, and the NC membrane, albumen glue and the filter paper are immersed into a membrane transfer buffer solution; the large filter paper, the NC membrane, the albumen glue and the small filter paper (the filter paper cannot be in contact with one another and does not have bubbles) are sequentially placed on a membrane transfer instrument, and membrane transfer is conducted for 15 min under 15 V;
5) after the membrane transfer is completed, washing is conducted for three times by using PBST (PBS+0.05% Tween 20), wherein washing is conducted for 10 minutes each time;
6) sealing: sealing is conducted for 2 hours at 37° C. by using sealing liquid (5 g of skim milk powder+100 mL of PBST); After sealing is finished, the sample is placed on a shaking table and washed with PBST for three times, wherein washing is conducted for 10 minutes each time;

7) a mouse 6×His antibody is added for incubation, namely 5 μL of a primary antibody is added into 10 mL of PBST according to a dilution ratio of 1:2000, and incubated on a shaking table at room temperature for 2 h (or overnight at 4° C.); after incubation is completed, the sample is placed on a shaking table and washed with PBST for three times, wherein washing is conducted for 10 minutes each time;

8) a rabbit anti-mouse-HPR antibody is added for incubation, namely 5 μL of a secondary antibody is added into 10 mL of PBST, and incubated on a shaking table at room temperature for 1 hour; after incubation is completed, the sample is placed on a shaking table and washed with PBST for three times, wherein washing is conducted for 10 minutes each time; and 9) developing is conducted after the last time of washing is completed, and ECL developing solutions A and B in equal volume are mixed to form 1 mL in total; the staining solution is sucked by using a 1 mL pipette, and dropwise added onto the NC membrane, developing is conducted in a dark place for 5 minutes, developing is stopped by using pure water, and the NC membrane is aired, and stored in a dark place.

Embodiment 3

Figure 2:
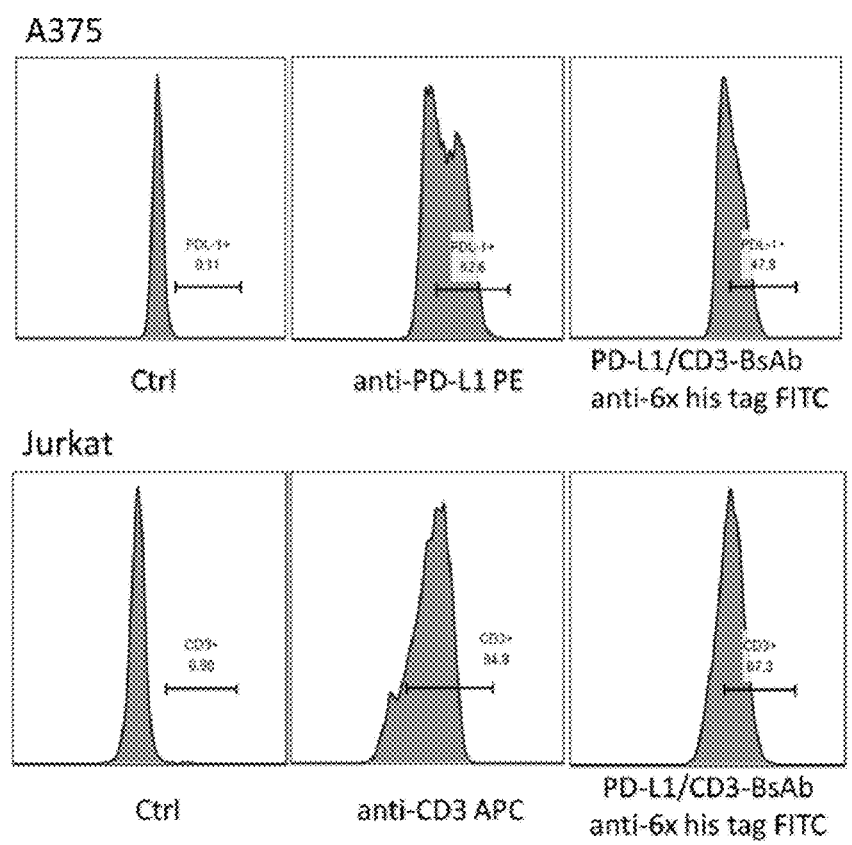
FIG. 2 is a flow cytometry diagram in a BsAb-PD-L1 cell binding experiment.

BsAb-PD-L1 Cell Binding Assay $1\times10^6$ Jurkat cells and A375 cells are respectively resuspended in 100 μL of PBS buffer solution, the A375 cells are respectively incubated with 1 μg of human PD-L1 antibody and 500 μL of BsAb-PD-L1 supernatant, the Jurkat cells are respectively incubated with 1 μg of human CD3 antibody and 500 μL of BsAb-PD-L1 supernatant, incubation is carried out at 4° C. for 25 min, PBS is added for cleaning twice, 1 μg of 6×His-FITC antibody is added into a BsAb-PD-L1 incubation group, incubation is carried out at 4° C. for 25 min, PBS is used for cleaning twice, up-flow detection is carried out, and the result is shown in FIG. 2.

Embodiment 4

Figure 3:
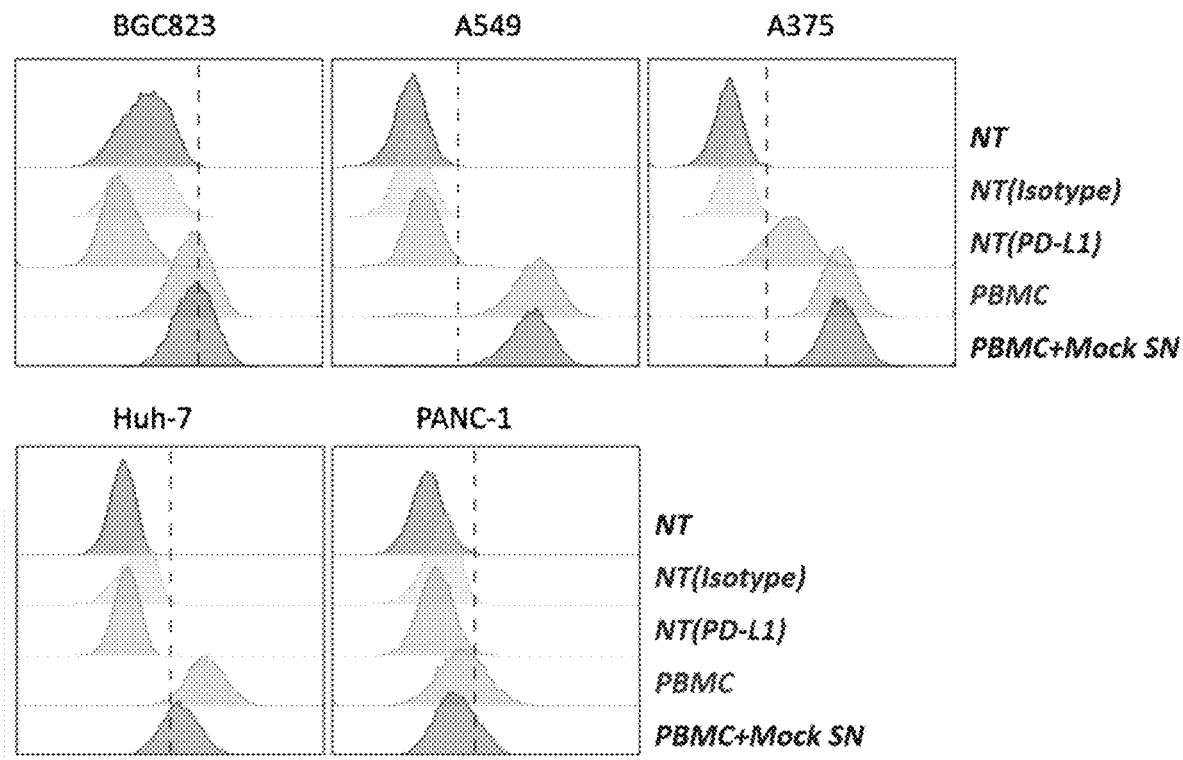
FIG. 3 is a flow cytometry diagram in a tumor cell PD-L1 expression detection experiment.
Figure 4:
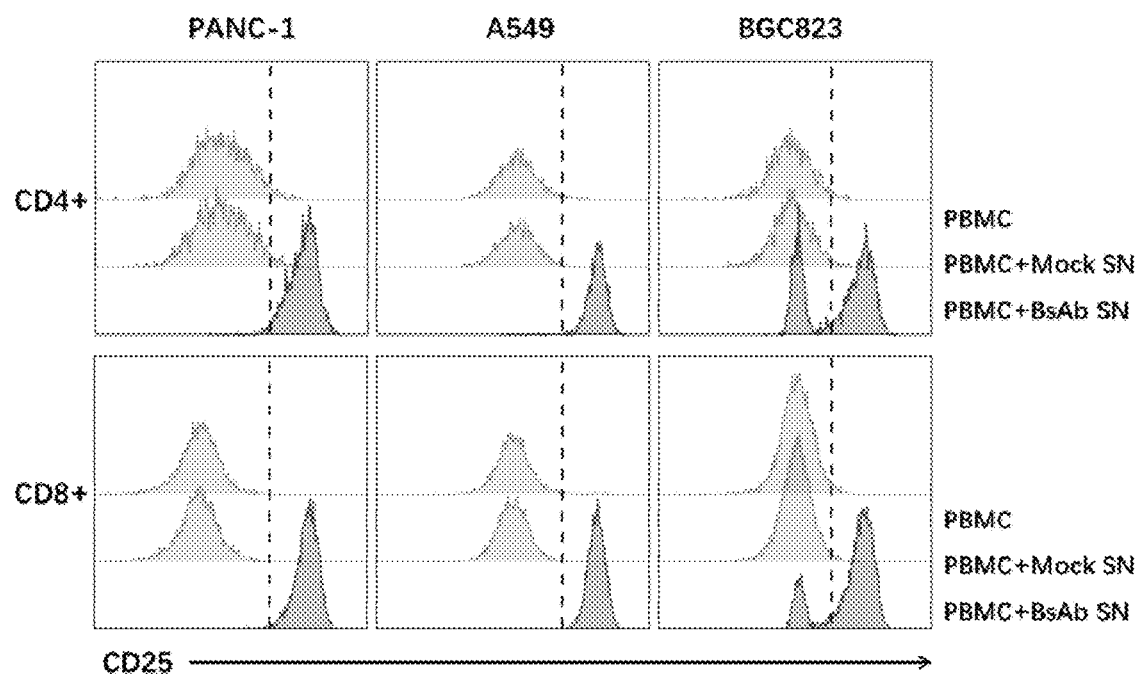
FIG. 4 is a flow cytometry diagram in a BsAb-PD-L1 mediated PBMC (peripheral blood mononuclear cell) activation experiment.
Figure 5:
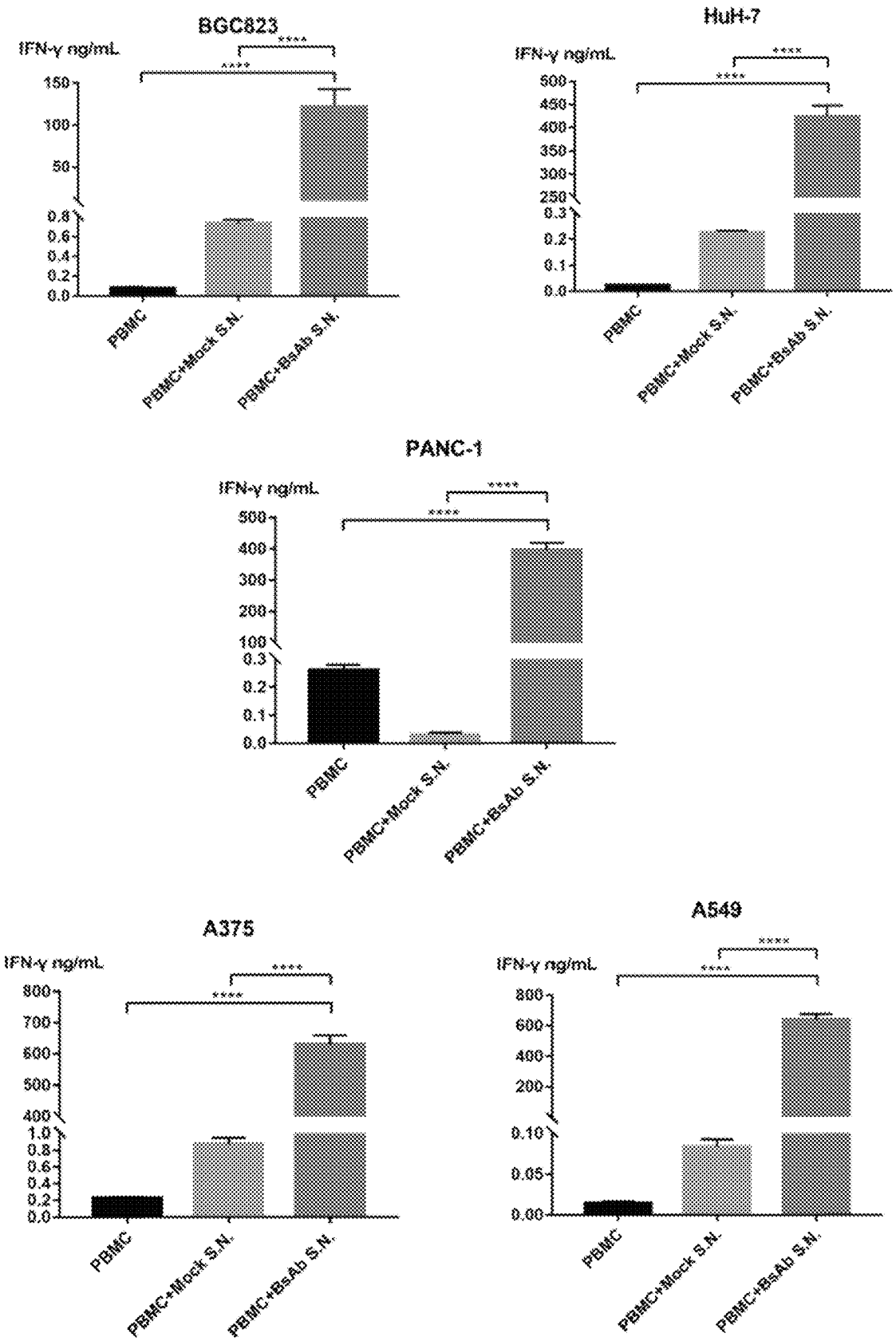
FIG. 5 is an IFN-γ detection result in a BsAb-PD-L1 mediated PBMC activation experiment.
Figure 6:
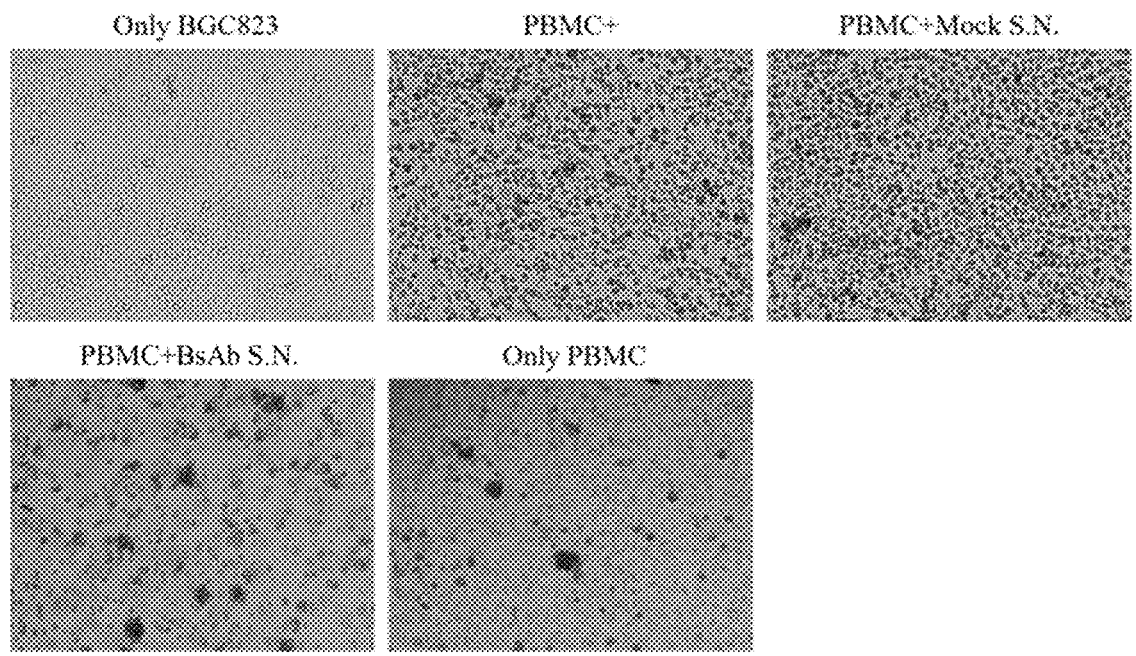
FIG. 6 is an effect comparison diagram of experimental results of killing the BGC823 cells by the BsAb-PD-L1 mediated PBMC.
Figure 7:
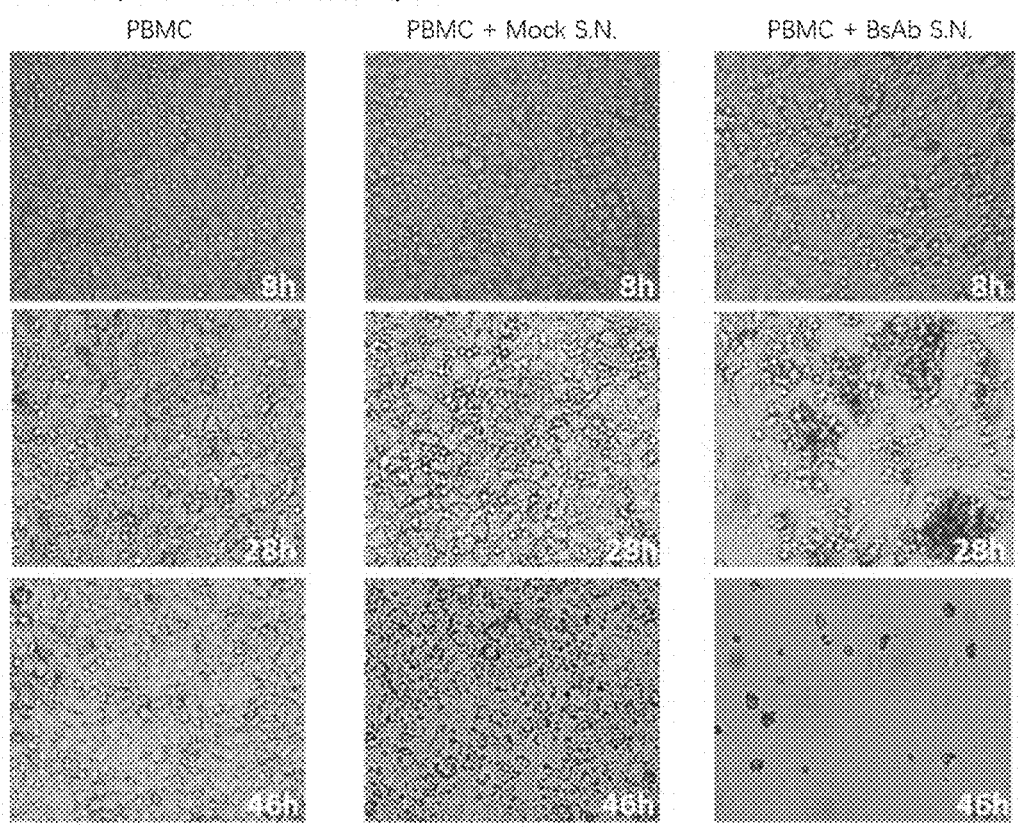
FIG. 7 is an effect comparison diagram of experimental results of killing the Huh-7 cells by the BsAb-PD-L1 mediated PBMC.
Figure 8:
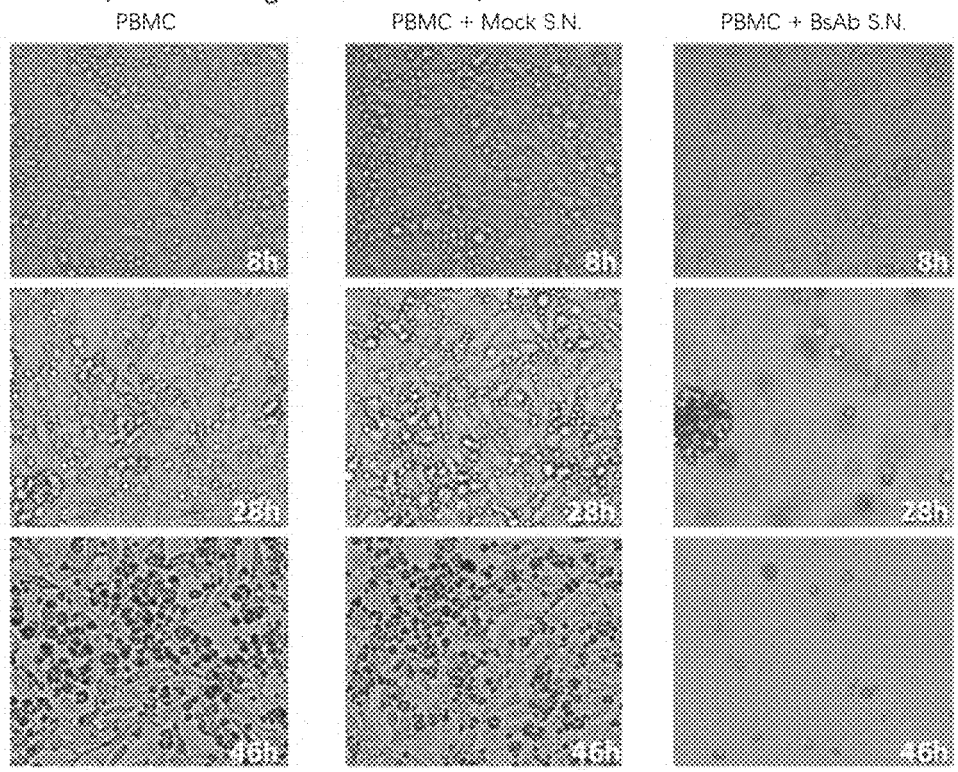
FIG. 8 is an effect comparison diagram of experimental results of killing A375 cells by the BsAb-PD-L1 mediated PBMC.

1) Tumor Cell PD-L1 Expression Detection $2\times10^4$ Huh-7 cells, Panc-1 cells, BGC823 cells, A549 cells and A375 cells are laid in a 96-well plate and cultured overnight in a cell incubator with the temperature of 37° C. and the $CO_2$ concentration of 5%; PBMCs (peripheral blood mononuclear cells) are added according to an effect-target ratio of 2:1 on the next day, and culturing is conducted in a cell incubator with the temperature of 37° C. and the $CO_2$ concentration of 5% for 48 hours; the supernatant is removed, and PBS is added for cleaning twice; the tumor cells are digested by pancreatin, and the tumor cells are cleaned twice by PBS; the tumor cells are incubated with 1 μg of human PD-L1 antibody at 4° C. for 25 minutes, washing twice is conducted with PBS, up-flow detection is carried out, and the result is shown in FIG. 3;

2) BsAb-PD-L1 Mediated PBMC Activation $2\times10^4$ Panc-1, BGC823 and A549 cells are laid in a 96-well plate and cultured overnight in a cell incubator with the temperature of 37° C. and the $CO_2$ concentration of 5%; Mock PBMC and BsAb-PD-L1 incubated PBMC are respectively added according to an effect-target ratio of 2:1 on the next day, and culturing is conducted in a cell incubator with the temperature of 37° C. and the $CO_2$ concentration of 5% for 48 hours; the PBMCs in the supernatant are taken, washed twice by using PBS, incubated with 1 μg of human CD4, CD8 and CD25 antibodies at 4° C. for 25 minutes, and washed twice by using PBS, up-flow detection is carried out, and the result is shown in FIG. 4;

$2\times10^4$ Huh-7 cells, Panc-1 cells, BGC823 cells, A549 cells and A375 cells are laid in a 96-well plate and cultured overnight in a cell incubator with the temperature of 37° C. and the $CO_2$ concentration of 5%; Mock PBMC and BsAb-PD-L1 incubated PBMC are respectively added according to an effect-target ratio of 2:1 on the next day, and culturing is conducted in a cell incubator with the temperature of 37° C. and the $CO_2$ concentration of 5% for 48 hours; a supernatant is taken, and centrifuged to remove cells; the IFN-γ in the supernatant is detected by using an Elisa kit, and the result is as shown in FIG. 5;

3) BsAb-PD-L1 Mediated PBMC Killing $2\times10^4$ Huh-7 cells, BGC823 cells and A375 cells are laid in a 96-well plate and cultured overnight in a cell incubator with the temperature of 37° C. and the $CO_2$ concentration of 5%; Mock PBMC and BsAb-PD-L1 incubated PBMC are respectively added according to an effect-target ratio of 2:1 on the next day, culturing is conducted in a cell incubator with the temperature of 37° C. and the $CO_2$ concentration of 5% for 48 hours, the killing condition is observed under a microscope, and the results are as shown in FIGS. 6-8.

Embodiment 5

A Process of oHSV2-BsAb-PD-L1 Preparation 1) a 6-well plate is inoculated with $4\times10^5$ ICP4 cells, and the cells are cultured in a 5% $CO_2$ environment at 37° C.; a genome of oHSV2-GFP and a pHG52d34.5-CMV-BsAb-PD-L1 plasmid are jointly transfected into the ICP4 cells by using a calcium phosphate transfection reagent on the next day, and whether toxic plaques are formed or not is observed after 24-48 hours; and 2) the cell wells with the toxic plaques are freeze-thawed for 5 minutes, centrifuging is conducted at 2000 g, a supernatant is collected, the supernatant is diluted by 100 times, 1000 times and 10000 times, and the ICP4 cells are infected; toxic plaques without green fluorescence are selected under a fluorescence microscope, the ICP4 cells are further infected, and toxic plaques without green fluorescence are repeatedly selected until the toxic plaques of the well plate do not have green fluorescence, so as to obtain the oHSV2-BsAb-PD-L1; and a virus genome is further extracted, and the virus is identified by using PCR (Polymerase Chain Reaction).

Figure 9:
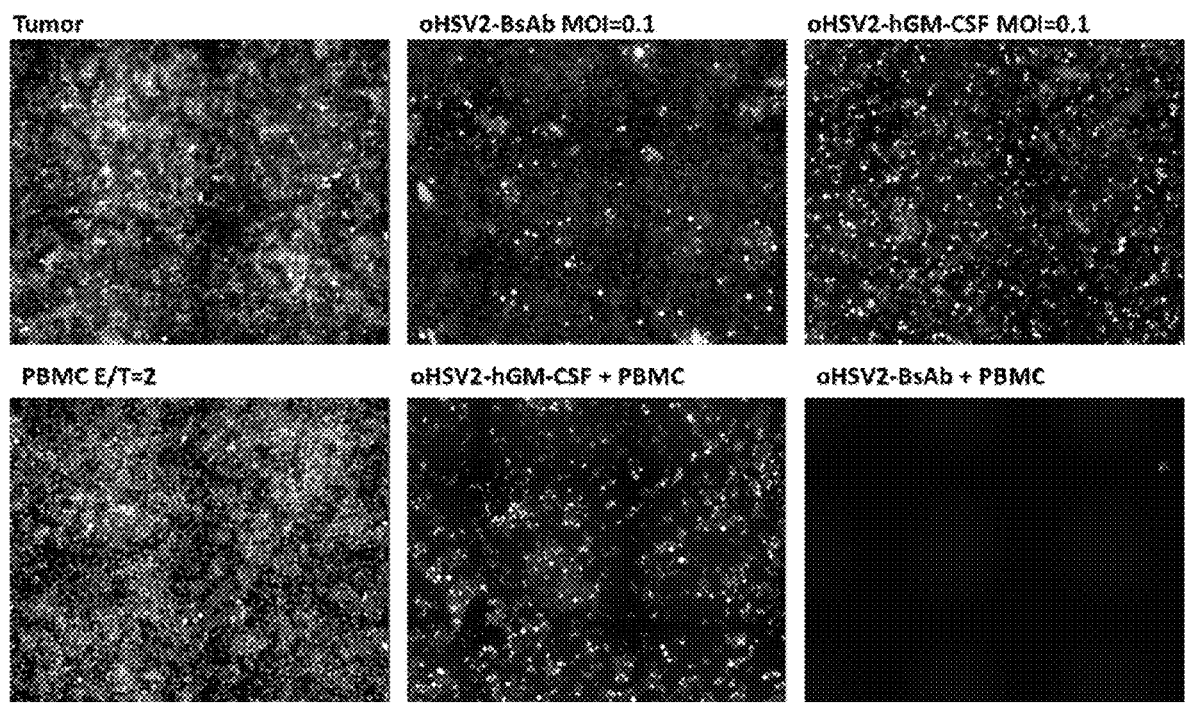
FIG. 9 is a high-throughput real-time imaging observation diagram in an oHSV2-BsAb-PD-L1 combined PBMC killing experiment.
Figure 10:
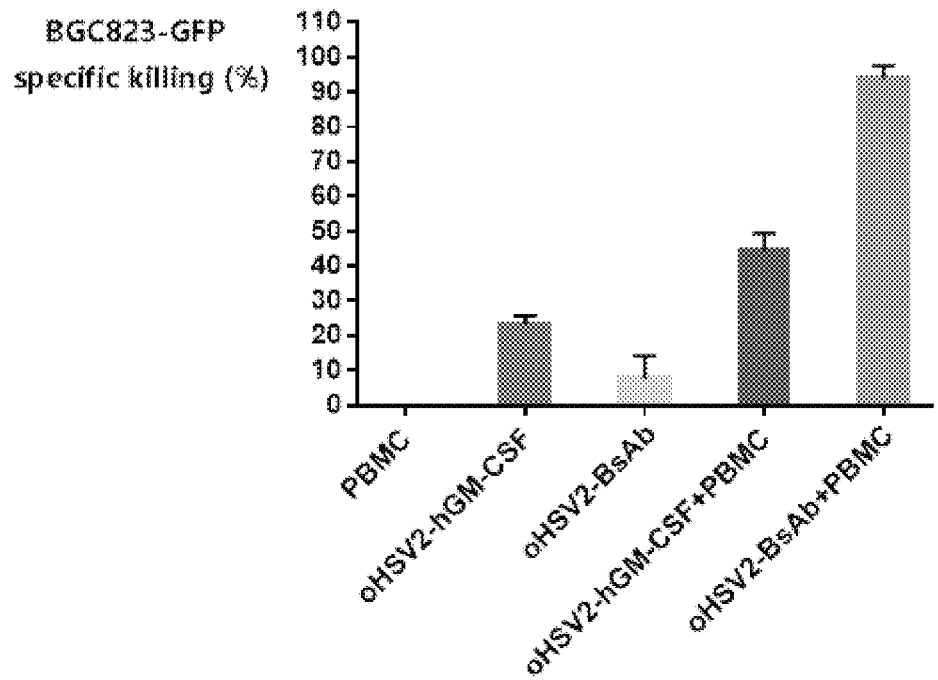
FIG. 10 is a data comparison graph of oHSV2-BsAb-PD-L1 combined PBMC killing.

Embodiment 6 oHSV2-BsAb-PD-L1 Combined PBMC Killing $2\times10^4$ BGC823-GFP cells are laid in a 96-well plate and cultured overnight in a cell incubator with the temperature of 37° C. and the $CO_2$ concentration of 5%; PBMCs (peripheral blood mononuclear cells) are respectively added according to an effect-target ratio of 2:1 on the next day, meanwhile, oHSV2-hGM-CSF and oHSV2-BsAb-PD-L1 are added according to MOI=0.1, groups are shown in Table 1 below, the cells are observed by using a high-throughput real-time imaging system, and the results are as shown in FIG. 9 and FIG. 10.

TABLE 1 oHSV2-BsAb-PD-L1 combined PBMC killing experiment grouping

| Group | Killing Rate |
| --- | --- |
| PBMC | 0% |
| oHSV2-hGM-CSF | 23.33% |
| oHSV2-BsAb-PD-L1 | 7.756% |
| oHSV2-hGM-CSF + PBMC | 44.20% |
| oHSV2-BsAb-PD-L1 + PBMC | 93.77% |

The oHSV2-hGM-CSF involved in the embodiments was preserved in the China General Microbiological Culture Collection Center (CGMCC, No. 3, yard 1, Beichen West Road, Chaoyang District, Beijing, China) on Feb. 3, 2010. The accession number is CGMCC no. 3600. The preserved biomaterial is H2d3d4-hGF strain, and its strain number means: H2 refers to herpes simplex virus type II HG52 strain (oHSV2); d3 refers to the elimination of ICP34.5; d4 refers to the elimination of ICP47; hGF refers to the insertion of human granulocyte macrophage colony stimulating factor (hGM-CSF) expression box. (The above information is disclosed in Chinese invention patent CN201010116275.3 "Recombinant Type II Herpes Simplex Virus Vector, Preparation Method for Same, Recombinant Virus, Pharmaceutical Composition and Application)

Part II Virus Composition

The oHSV2-hGM-CSF involved in the following embodiments is the same as that in embodiment 6, it can also be abbreviated as oHSV2-GMCSF. Similar to the construction of the oHSV2-hGM-CSF, a series of oncolytic viruses are constructed, which are all modifications of HG52 strain, eliminate ICP34.5 and ICP47, then insert foreign genes into ICP 34.5 sites rather than hGM-CSF expression box, see the table below.

TABLE 2

| | Full Name of Virus | Foreign Gene | Foreign Gene amino acid Sequence Number | Foreign Gene nucleotide Sequence Number | Viral gene sequence Number |
| --- | --- | --- | --- | --- | --- |
| 1 | oHSV2-BsAb-PD-L1 | BsAb-PD-L1 | SEQ ID No. 1 | / | SEQ ID No. 16 |
| 2 | oHSV2-OX40L | OX40L | SEQ ID No. 2 | SEQ ID No. 9 | SEQ ID No. 17 |
| 3 | oHSV2-IL12 | IL12 | SEQ ID No. 3 | SEQ ID No. 10 | SEQ ID No. 18 |
| 4 | oHSV2-neo | neo | SEQ ID No. 4 | SEQ ID No. 11 | SEQ ID No. 19 |
| 5 | oHSV2-IL15 | IL15 | SEQ ID No. 5 | SEQ ID No. 12 | SEQ ID No. 20 |
| 6 | oHSV2-PD1v | PD1v | SEQ ID No. 6 | SEQ ID No. 13 | SEQ ID No. 21 |
| 7 | oHSV2-antiPD1 | antiPD1 | SEQ ID No. 7 | SEQ ID No. 14 | SEQ ID No. 22 |
| 8 | oHSV2-hGM-CSF | GM-CSF | SEQ ID No. 8 | SEQ ID No. 15 | SEQ ID No. 23 |

Embodiment 7

1. Experimental Purpose

The anti-tumor effects of various oncolytic viruses were compared in BALB/c tumor bearing mouse model of mouse colon cancer cell CT26-iRFP.

In order to simplify the identification in the figures, The virus name of the experimental group is abbreviated as follows: oHSV2-hGM-CSF (hGM-CSF), oHSV2-IL15 (IL15), oHSV2-IL12 (IL12), oHSV2-PD1v (PD1v), oHSV2-antiPD1 (antiPD1) and oHSV2-neo (neo).

The tumor formation was induced by subcutaneous injection of mouse colon cancer cells (CT26) into the right costal abdomen of BALB/c mice, and randomly grouping, including negative control group (Control). The treatment was started when the tumor volume reached about 120 mm³. The first treatment was on the first day. The corresponding viruses were injected into the tumor of the experimental groups, and the Inositol Sorbitol Buffer (IS buffer is generally used to resuspend virus) was injected into the tumor of the Control group (IS buffer is a common reagent, which can be sold on the market or prepared by ourselves, and its composition difference will not affect the experimental results). The treatment was carried out for 3 times (on the 1st/4th/7th day). After the first injection, the test mice were observed.

2. Experimental Principle

The experimental principle refers to Standard Operating Procedures [CT26 tumor cell culture SOP] and [inducing CT26 tumor in vivo SOP].

3. Experimental Design and Methods 3.1 Experimental Materials, Animal Reagents and Consumables Viruses: all viruses are produced according to the same standard scheme. All viruses were resuspended in the preparation buffer and sub frozen in the refrigerator at −70° C. for rapid thawing before use.

Animals: female BALB/c normal mice were purchased from Hubei Food And Drug Safety Evaluation Center and raised in a pathogen free animal laboratory. The size of animals at the time of administration was 5-7 weeks (weight 16-20 g). It was distinguished by marking the mouse tail.

3.2 Experimental Methods 3.2.1 Preparation of CT26 Cells

Colon cancer cells derived from mice were cultured according to the standard protocol (CT26-iRFP, purchased from the National Experimental Cell Resource Sharing Platform. CT26-iRFP was modified on the basis of parental cells to continuously express near-infrared fluorescent protein). The culture medium was DMEM/F12 containing 10% fetal bovine serum. Before tumor induction, the cells were collected, centrifuged at 820 g for 5 min, and then remixed with serum-free DMEM/F12.

3.2.2 Tumor Model

Tumor induction, female BALB/c normal mice (7-9 mice in each group) were injected subcutaneously into the right costal abdomen with 100 μl cell suspension containing $2\times10^6$ CT26 mouse colon cancer cell. Then measure the long diameter (a) and short diameter (b) of the tumor every day. The calculation formula of tumor volume (TV) is: $V=\frac{1}{2}\times a\times b^2$. The a and b represent length and width, respectively.

3.2.3 Virus Therapy

When the average tumor volume reached about 120 mm³, the treatment was started. The first treatment was on the first day. On the first, fourth and seventh days, the tumor bearing mice in the treatment group were injected with the corresponding virus ($2\times10^5$ CCID$_{50}$/100 µl/piece); The two Control groups of tumor bearing mice were injected with equal volume of IS buffer (100 µl).

E6 (evaluation of the effect of single virus in the treatment of CT26-iRFP): dilute the virus with IS buffer to a titer of $1\times10^7$ CCID$_{50}$/ml, and administrate 100 µl to each mouse, that is, administrate $1\times10^6$ CCID$_{50}$ to each mouse.

E5 (cocktail virus comparison): dilute the virus with IS buffer to a titer of $1\times10^6$ CCID$_{50}$/ml, and administrate 100 µl to each mouse, that is, administrate $1\times10^5$ CCID$_{50}$ to each mouse.

Cocktail virus: first dilute several viruses to the target titer, and then mix several required viruses one by one. The mixed virus is called cocktail virus.

Figure 13:
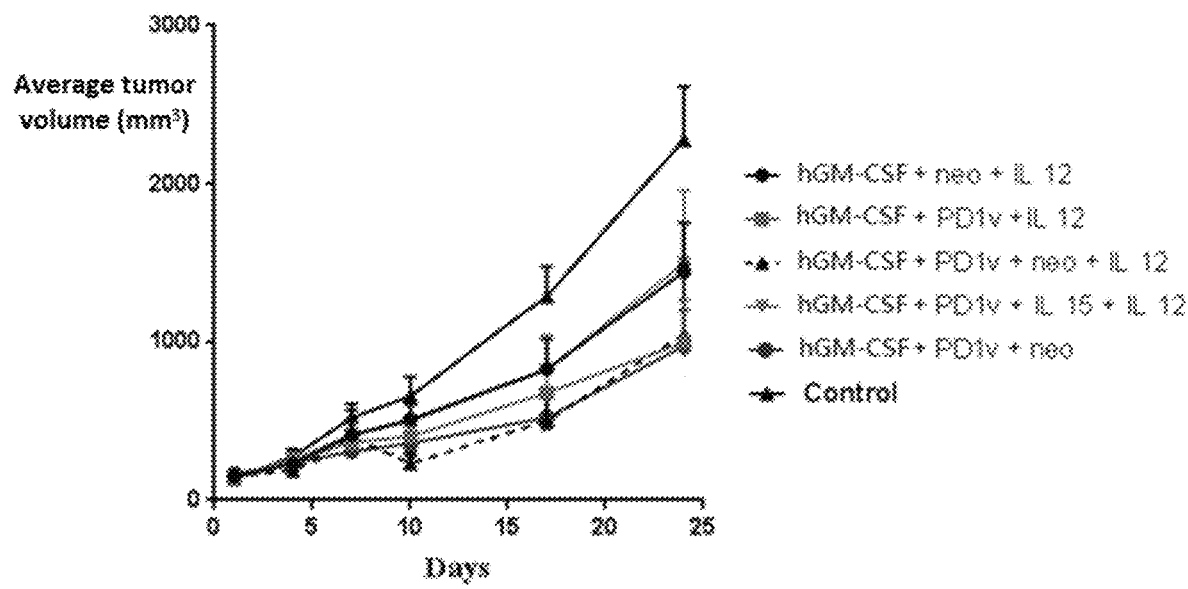
FIG. 13 is an overall effect comparison diagram of various viruses in the treatment of mouse colon cancer CT26-iRFP.
Figure 14:
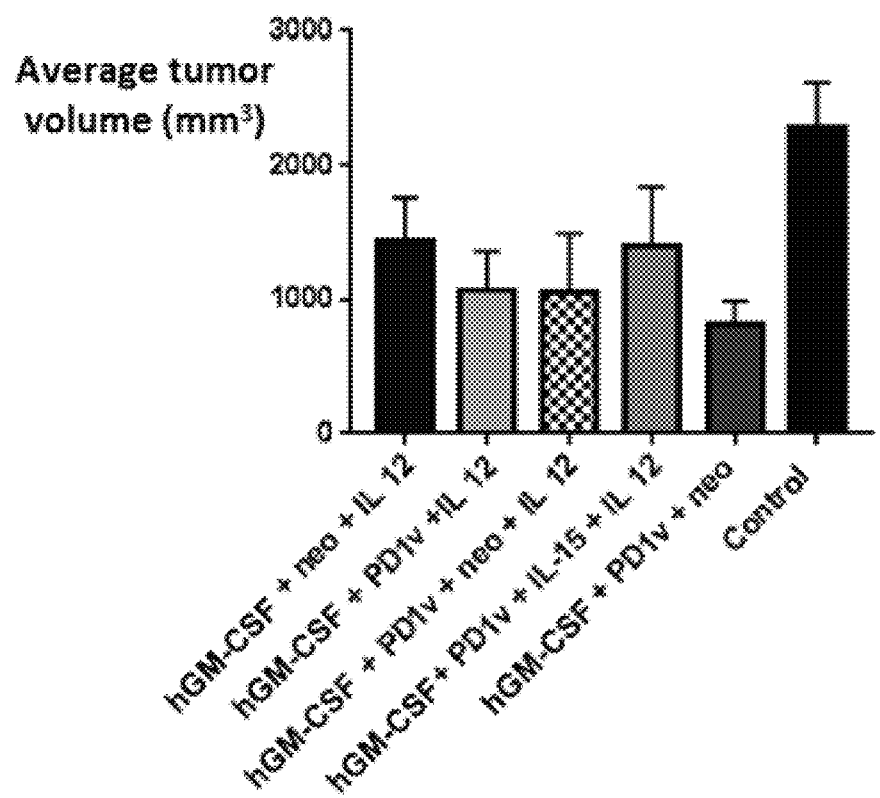
FIG. 14 is an effect comparison diagram of various viruses on the 24th day in the treatment of mouse colon cancer CT26-iRFP.

The grouping identification in the figure has been simplified, as shown in FIG. 13 and FIG. 14, the hGM-CSF+PD1v+neo group means that after diluting the three viruses oHSV2-hGM-CSF, oHSV2-PD1v and oHSV2-neo to $1\times10^6$ CCID$_{50}$/ml, 1 ml of each virus is mixed together to obtain the final 3 ml cocktail virus.

4. Evaluation Criteria for the Effectiveness of Experimental Results

The data were processed by statistical software and expressed by Mean±SEM. One way ANOVA was used for comparison between groups. $P<0.05$ means statistical significance.

Figure 11:
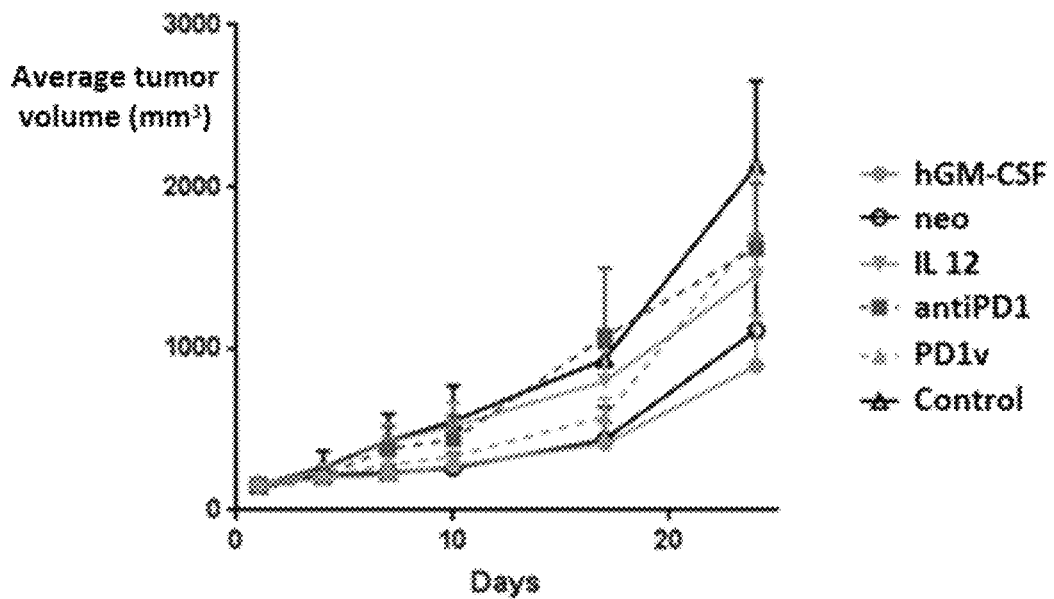
FIG. 11 is an overall effect comparison diagram of single virus in the treatment of mouse colon cancer CT26-iRFP.
Figure 12:
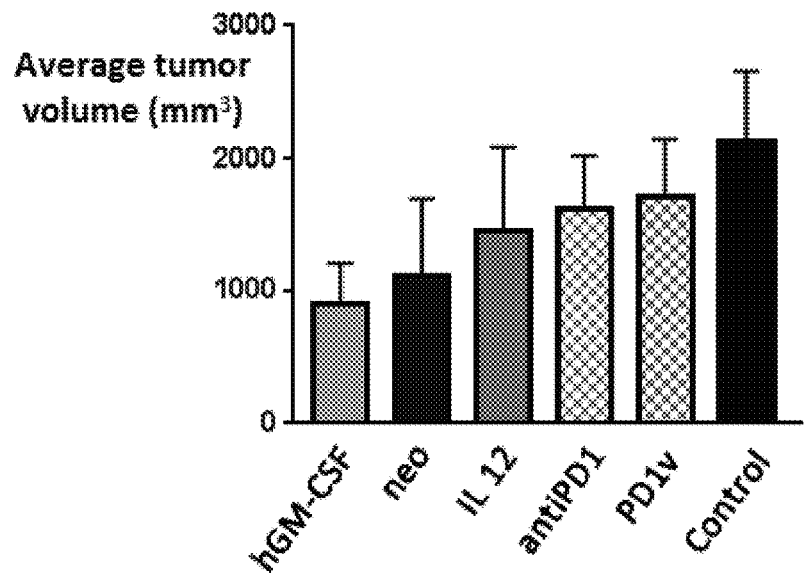
FIG. 12 is an effect comparison diagram of single virus on the 24th day in the treatment of mouse colon cancer CT26-iRFP.

The grouping experiment results are shown in FIGS. 11 to 15 (the results of single virus treatment are shown in FIG. 11 and FIG. 12, and the results of cocktail virus treatment are shown in FIG. 13 and FIG. 14). IL12 and IL15 activate T and NK cells respectively. PD1v can bind to PD-L1 with high affinity and block the negative regulation of PD-1/PD-L1. Then, the antitumor efficacy of a series of oncolytic viruses in vivo and in vitro was evaluated. Using the colon cancer bearing mouse model (CT26-iRFP) expressing near infrared red fluorescent protein, the therapeutic effects of oHSV2 carrying foreign gene were compared by intratumoral injection. The results showed that oHSV2-hGM-CSF and oHSV2-neo had the most obvious antitumor effect compared with other viruses.

Figure 15:
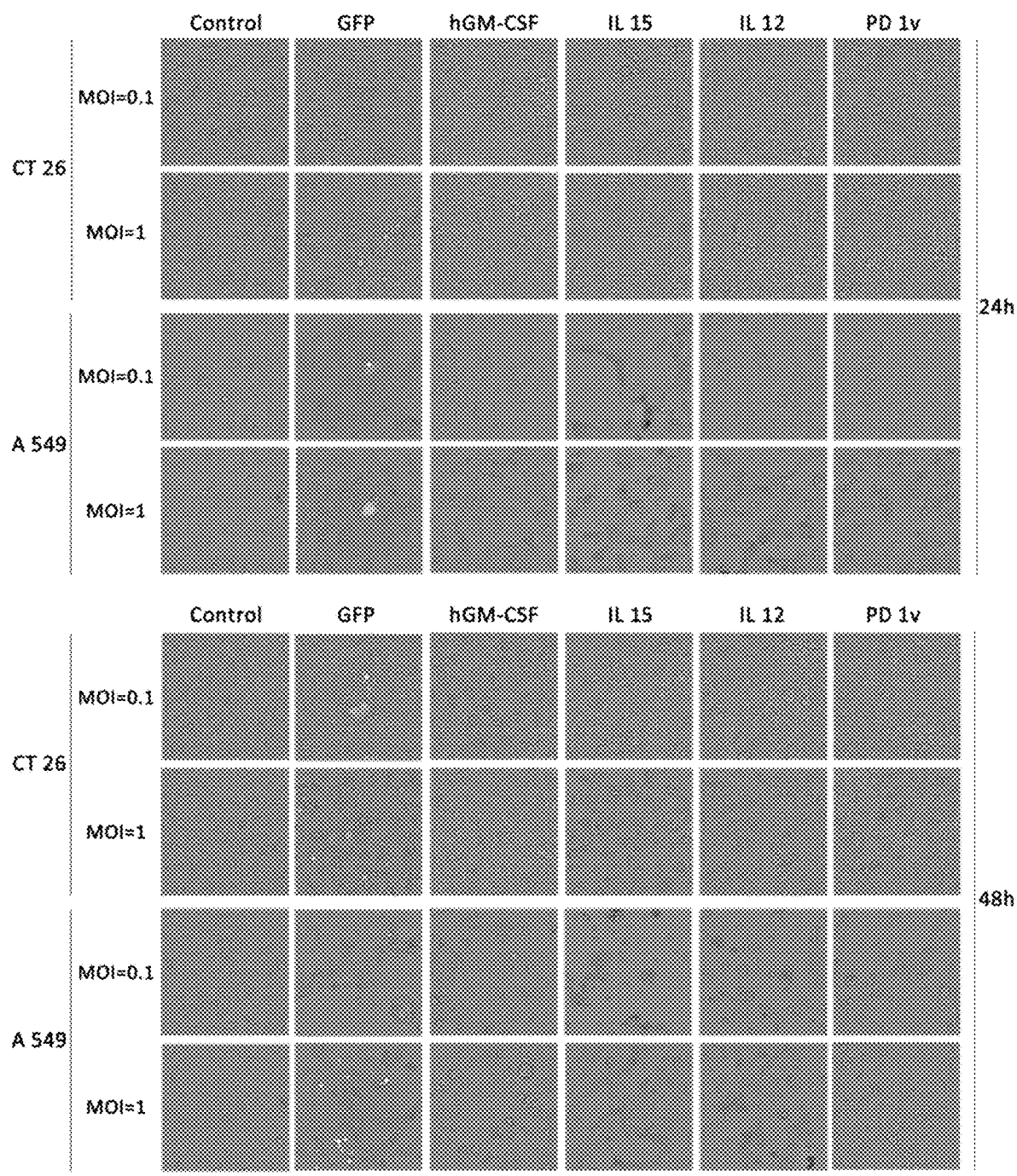
FIG. 15 shows the comparison of cell killing results.

It can be observed from FIG. 15 that in vitro killing experiments were carried out on A549 cells and CT26 cells infected with oncolytic viruses carrying different exogenous factors with MOI of 0.1 and 1. At 24 h and 48 h, compared with the Control group, the tumor cells in the experimental group showed different degrees of morphological changes and even death. It is suggested that oncolytic virus has tumor cell killing effect in vitro.

Embodiment 8

Cocktail Virus Treatment Experiment

1. Experimental Purpose

BALB/c tumor bearing mouse model of mouse colon cancer cell CT26-hPDL1 was used to compare various virus compositions.

2. Experimental Materials

Tumor cell line: CT26-hPDL1 (GFP expression 99.8% and hPDL1 expression 73.4%, purchased from the National Experimental Cell Resource Sharing Platform. CT26-hPDL1 is modified on the basis of parent cells to continuously express human PDL1 protein)

Mice: 130 female BALB/c mice (6-8 weeks old)

oHSV2 virus: dilute the virus with IS buffer to a titer of $1\times10^7$ CCID$_{50}$/ml, and administrate 100 µl to each mouse, that is, administrate $1\times10^6$ CCID$_{50}$ to each mouse.

3. Experimental Steps

Administration Time: intratumoral injection, administration on days 1, 4 and 7, and other unspecified steps are the same as those in embodiment 7.

TABLE 3

| Group number | Administered Virus/Virus Mixture |
|---|---|
| 1 | oHSV2-BsAb-PD-L1 |
| 2 | oHSV2-hGM-CSF |
| 3 | oHSV2-OX40L |
| 4 | oHSV2-PD1v |
| 5 | oHSV2-neo |
| 6 | oHSV2-IL12 |
| 7 | oHSV2-hGM-CSF + oHSV2-BsAb-PD-L1 |
| 8 | oHSV2-OX40L + oHSV2-BsAb-PD-L1 |
| 9 | oHSV2-hGM-CSF + oHSV2-OX40L |
| 10 | oHSV2-OX40L + oHSV2-BsAb-PD-L1 + oHSV2-hGM-CSF |
| 11 | oHSV2-PD1v + oHSV2-neo + oHSV2-hGM-CSF |
| 12 | oHSV2-BsAb-PD-L1 + oHSV2-hGM-CSF + oHSV2-OX40L + oHSV2-PD1v + oHSV2-neo + oHSV2-IL12 |
| 13 | IS Buffer |

In the group name shown in the figures, except oHSV2-BsAb-PD-L1 is abbreviated as BsAb, oHSV2-OX40L is abbreviated as OX40L, Group 12 is abbreviated as 6mix, and other viruses are abbreviated as in embodiment 7.

4. Experimental Data Collection: the first treatment time was recorded as the first day, and then the long diameter and short diameter of the tumor were measured on the 1st, 4th, 7th, 10th, 14th, 21st and 28th days of treatment.

Figure 16:
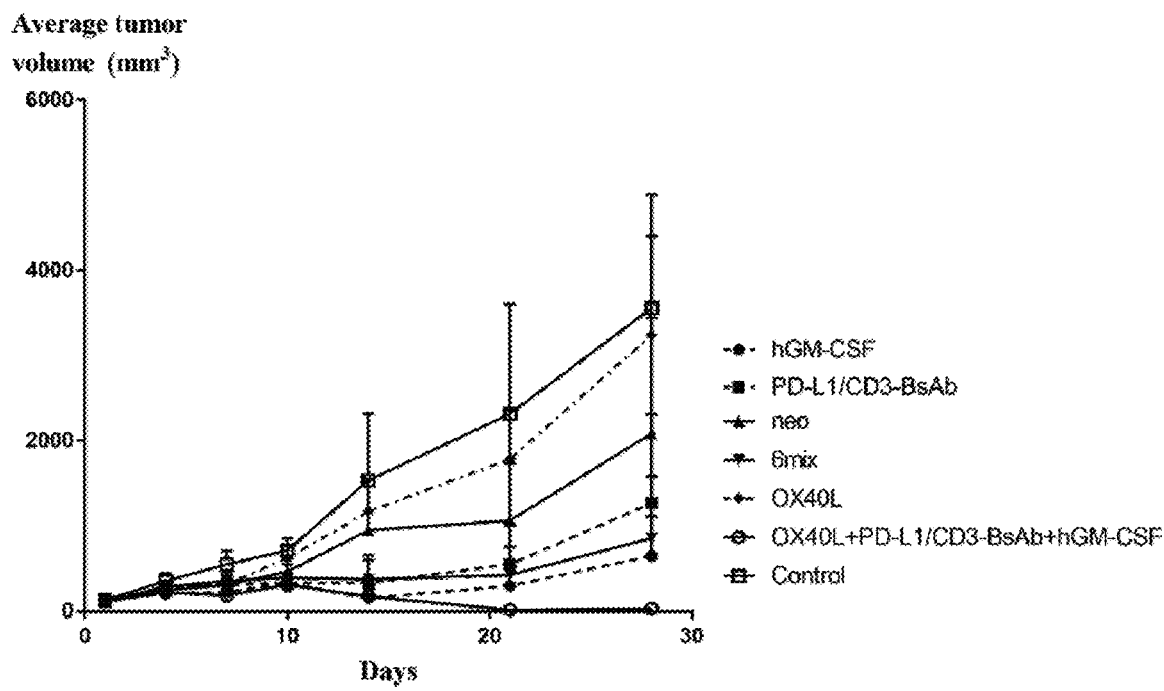
FIG. 16 is an overall effect comparison diagram of various viruses in the treatment of mouse colon cancer CT26-hPDL1.
Figure 17:
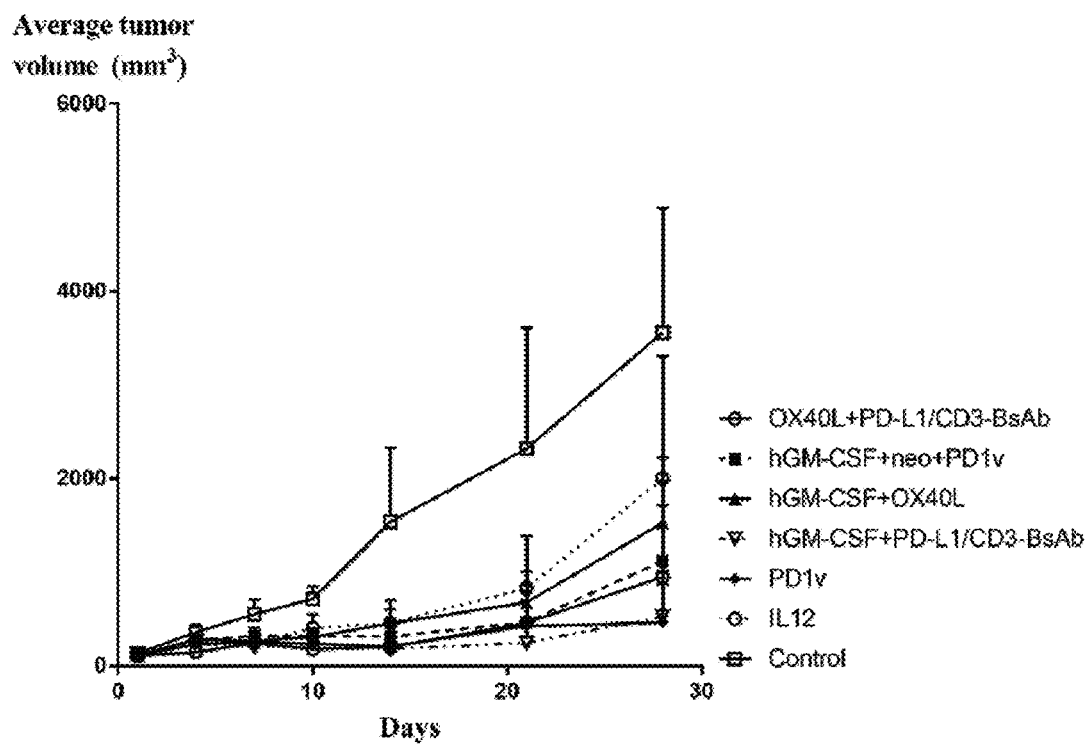
FIG. 17 is an overall effect comparison diagram of various viruses in the treatment of mouse colon cancer CT26-hPDL1.
Figure 18:
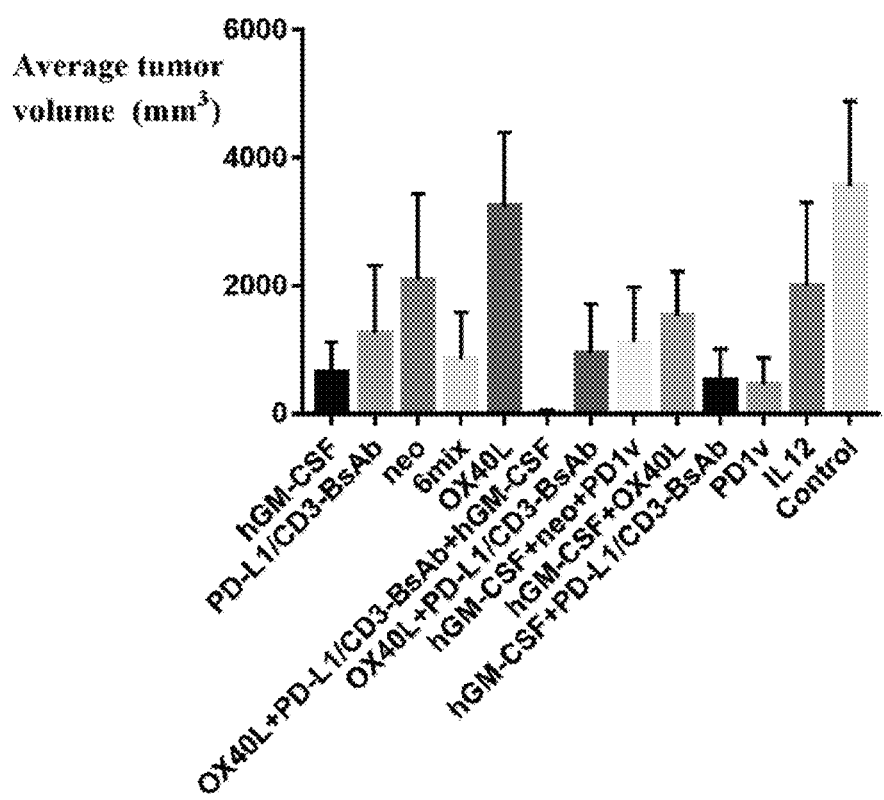
FIG. 18 is a comparison diagram of the average tumor size on the 28th day in the treatment of mouse colon cancer CT26-hPDL1 with various viruses.

The results are shown in the following table and FIGS. 16~18.

TABLE 4

Tumor Growth Data of Virus Treatment Group

| Group | Survival Rate | Tumor Clearance |
|---|---|---|
| hGM-CSF | 80.00% | 60.00% |
| BsAb | 80.00% | 80.00% |
| neo | 77.80% | 44.40% |
| 6 mix | 88.90% | 77.80% |
| OX40L | 40.00% | 30.00% |
| OX40L + BsAb + hGM-CSF | 100.00% | 80.00% |
| OX40L + BsAb | 80.00% | 80.00% |
| hGM-CSF + neo + PD1v | 80.00% | 70.00% |
| hGM-CSF + OX40L | 60.00% | 50.00% |
| hGM-CSF + BsAb | 90.00% | 60.00% |
| PD1v | 80.00% | 70.00% |
| IL12 | 60.00% | 40.00% |
| Control | 44.40% | 0.00% |

The results showed that in general, the effect of virus composition therapy was better than that of single virus group, especially the survival rate of OX40L+BsAb+hGM-CSF group was higher, which was more effective in inhibiting tumor growth. Its comprehensive effect was even stronger than that of 6mix group, and other groups such as hGM-CSF+BsAb also had better effects. These data show that the combination therapy of multiple viruses loaded with foreign genes has strong antitumor effect, but the number of foreign genes was not the more the better.

SEQUENCE LISTING (23 sequences)

SEQ ID NO: 1 - protein, 515 aa, synthetic construct
MNFGLSLIFLVLILKGVQCEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSAAGGGGSGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH

SEQ ID NO: 2 - protein, 183 aa, synthetic construct
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 3 - protein, 591 aa, synthetic construct
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSVPGVGVPGVGMWPPGSASQPPPSPAAATGLHPAARPVSLQCRLSMCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 4 - protein, 141 aa, synthetic construct
MYRMQLLSCIALSLALVTNSMGSSHHHHHHSSGLVPRGSHMPKKKIQLHAEHALYDALMILNIVKTNSPPAEEKLEDYAFNFELILEEIARLFESGDQKDEAEKAKRMKEWMKRIKTTASEDEQEEMANAIITILQSWIFS

SEQ ID NO: 5 - protein, 162 aa, synthetic construct
MKILKPYMRNTSISCYLCFLLNSHFLTEAGIHVFILGCVSVGLPKTEANWIDVRYDLEKIESLIQSIHIDTTLYTDSDFHPSCKVTAMNCFLLELQVILHEYSNMTLNETVRNVLYLANSTLSSNKNVAESGCKECEELEEKTFTEFLQSFIRIVQMFINTS

SEQ ID NO: 6 - protein, 301 aa, synthetic construct
MQIPQAPWPVVWAVLQLGWRPGWFLDSPDRPWNPPTFSPALLVVTEGDNATFTCSFSNTSESFHVVWHRESPSGQTDTLAAFPEDRSQPGQDCRFRVTQLPNGRDFHMSVVRARRNDSGTYVCGVISLAPKIQIKESLRAELRVTERRAEVPTAHPSPSPRPAGQFQTLEPKSCDKTHTCPPCPAPELLGGPSVGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7 - protein, 688 aa, synthetic construct
MQVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGSGATNFSLLKQAGDVEENPGPEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8 - protein, 144 aa, synthetic construct
MWLQSLLLLGTVACSISAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 9 - protein, 552 aa, synthetic construct
ATGGAAAGGGTCCAACCCCTGGAAGAGAATGTGGGAAATGCAGCCAGGCCAAGATTCGAGAGGAACAAGCTATTGCTGGTGGCCTCTGTAATTCAGGGACTGGGGCTGCTCCTGTGCTTCACCTACATCTGCCTGCACTTCTCTGCTCTTCAGGTATCACATCGGTATCCTCGAATTCAAAGTATCAAAGTACAATTTACCGAATATAAGAAGGAGAAAGGTTTCATCCTCACTTCCCAAAAGGAGGATGAAATCATGAAGGTGCAGAACAACTCAGTCATCATCAACTGTGATGGGTTTTATCTCATCTCCCTGAAGGGCTACTTCTCCCAGGAAGTCAACATTAGCCTTCATTACCAGAAGGATGAGGAGCCCCTCTTCCAACTGAAGAAGGTCAGGTCTGTCAACTCCTTGATGGTGGCCTCTCTGACTTACAAAGACAAAGTCTACTTGAATGTGACCACTGACAATACCTCCCTGGATGACTTCCATGTGAATGGCGGAGAACTGATTCTTATCCATCAAAATCCTGGTGAATTCTGTGTCCTTTAA

SEQ ID NO: 10 - DNA, 1776 bp, synthetic construct
  source 1..1776: mol_type = other DNA
atgtgccaccagcagctggtgatcagctggttcagcctggtgttcctggccagccccctggtggccatctgggagctgaagaaggacgtgtacgtggtggagctggactggtaccccgacgcccccggcgagatggtggtgctgacctgcgacacccccgaggaggacggcatcacctggaccctggaccagagcagcgaggtgctgggcagcggcaagaccctgaccatccaggtgaaggagttcggcgacgccggccagtacacctgccacaagggcggcgaggtgctgagccacagcctgctgctgctgcacaagaaggaggacggcatctggagcaccgacatcctgaaggaccagaaggagcccaagaacaagaccttcctgcggtgcgaggccaagaactacagcggccggttcacctgctggtggctgaccaccatcagcaccgacctgaccttcagcgtgaagagcagccggggcagcagcgacccccagggcgtgacctgcggcgccgccaccctgagcgccgagcgggtgcggggcgacaacaaggagtacgagtacagcgtggagtgccaggaggacagcgcctgccccgccgccgaggagagcctgcccatcgaggtgatggtggacgccgtgcacaagctgaagtacgagaactacaccagcagcttcttcatccgggacatcatcaagcccgacccccccaagaacctgcagctgaagcccctgaagaacagccggcaggtggaggtgagctgggagtaccccgacacctggagcaccccccacagctacttcagcctgaccttctgcgtgcaggtgcagggcaagagcaagcgggagaagaaggaccgggtgttcaccgacaagaccagcgccaccgtgatctgccggaagaacgccagcatcagcgtgcgggcccaggaccggtactacagcagcagctggagcgagtgggccagcgtgccctgcagcgtgcccggcgtgggcgtgcccggcgtgggcatgtggccccccggcagcgccagccagcccccccccagccccgccgccgccaccggcctgcaccccgccgcccggcccgtgagcctgcagtgccggctgagcatgtgccccgcccggagcctgctgctggtggccaccctggtgctgctggaccacctgagcctggcccggaacctgcccgtggccacccccgaccccggcatgttcccctgcctgcaccacagccagaacctgctgcgggccgtgagcaacatgctgcagaaggcccggcagaccctggagttctacccctgcaccagcgaggagatcgaccacgaggacatcaccaaggacaagaccagcaccgtggaggcctgcctgcccctggagctgaccaagaacgagagctgcctgaacagccgggagaccagcttcatcaccaacggcagctgcctggccagccggaagaccagcttcatgatggccctgtgcctgagcagcatctacgaggacctgaagatgtaccaggtggagttcaagaccatgaacgccaagctgctgatggaccccaagcggcagatcttcctggaccagaacatgctggccgtgatcgacgagctgatgcaggccctgaacttcaacagcgagaccgtgccccagaagagcagcctggaggagcccgacttctacaagaccaagatcaagctgtgcatcctgctgcacgccttccggatccgggccgtgaccatcgaccgggtgatgagctacctgaacgccagctga

SEQ ID NO: 11 - DNA, 426 bp, synthetic construct
  source 1..426: mol_type = other DNA
atgtaccggatgcagctgctgagctgcatcgccctgagcctggccctggtgaccaacagcatgggcagcagccaccaccaccaccaccacagcagcggcctggtgccccggggcagccacatgcccaagaagaagatccagctgcacgccgagcacgccctgtacgacgccctgatgatcctgaacatcgtgaagaccaacagcccccccgccgaggagaagctggaggactacgccttcaacttcgagctgatcctggaggagatcgcccggctgttcgagagcggcgaccagaaggacgaggccgagaaggccaagcggatgaaggagtggatgaagcggatcaagaccaccgccagcgaggacgagcaggaggagatggccaacgccatcatcaccatcctgcagagctggatcttcagctga

SEQ ID NO: 12 - DNA, 489 bp, synthetic construct
  source 1..489: mol_type = other DNA
atgaaaattttgaaaccatatatgaggaatacatccatctcgtgctacttgtgtttccttctaaacagtcactttttaactgaggctggcattcatgtcttcattttgggctgtgtcagtgtaggtctccctaaaacagaggccaactggatagatgtaagatatgacctggagaaaattgaaagccttattcaatctattcatattgacaccactttatacactgacagtgactttcatcccagttgcaaagttactgcaatgaactgctttctcctggaattgcaggttattttacatgagtacagtaacatgactcttaatgaaacagtaagaaacgtgctctaccttgcaaacagcactctgtcttctaacaagaatgtagcagaatctggctgcaaggaatgtgaggagctggaggagaaaaccttcacagagtttttgcaaagctttatacgcattgtccaaatgttcatcaacacgtcctaa

SEQ ID NO: 13 - DNA, 906 bp, synthetic construct
  source 1..906: mol_type = other DNA
atgcagatcccccaggccccctggcccgtggtgtgggccgtgctgcagctgggctggcggcccggctggttcctggacagccccgaccggccctggaacccccccaccttcagccccgccctgctggtggtgaccgagggcgacaacgccaccttcacctgcagcttcagcaacaccagcgagagcttccacgtggtgtggcaccgggagagccccagcggccagaccgacaccctggccgccttccccgaggaccggagccagcccggccaggactgccggttccgggtgacccagctgcccaacggccgggacttccacatgagcgtggtgcgggcccggcggaacgacagcggcacctacgtgtgcggcgtgatcagcctggcccccaagatccagatcaaggagagcctgcgggccgagctgcgggtgaccgagcggcgggccgaggtgcccaccgcccaccccagccccagcccccggcccgccggccagttccagaccctggagcccaagagctgcgacaagacccacacctgccccccctgccccgcccccgagctgctgggcggccccagcgtgggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcaagtaa

SEQ ID NO: 14 - DNA, 2067 bp, synthetic construct
  source 1..2067: mol_type = other DNA
atgcaggtgcagctggtgcagagcggcgtggaggtgaagaagcccggcgccagcgtgaaggtgagctgcaaggccagcggctacaccttcaccaactactacatgtactgggtgcggcaggcccccggccagggcctggagtggatgggcggcatcaaccccagcaacggcggcaccaacttcaacgagaagttcaagaaccgggtgaccctgaccaccgacagcagcaccaccaccgcctacatggagctgaagagcctgcagttcgacgacaccgccgtgtactactgcgcccggcgggactaccggttcgacatgggcttcgactactggggccagggcaccaccgtgaccgtgagcagcgccagcaccaagggccccagcgtgttccccctggccccctgcagccggagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagcgggtggagagcaagtacggccccccctgccccccctgccccgcccccgagttcctgggcggccccagcgtgttcctgttcccccccaagcccaaggacaccctgatgatcagccggacccccgaggtgacctgcgtggtggtggacgtgagccaggaggaccccgaggtgcagttcaactggtacgtggacggcgtggaggtgcacaacgccaagaccaagccccgggaggagcagttcaacagcacctaccgggtggtgagcgtgctgaccgtgctgcaccaggactggctgaacggcaaggagtacaagtgcaaggtgagcaacaagggcctgcccagcagcatcgagaagaccatcagcaaggccaagggccagccccgggagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagccggctgaccgtggacaagagccggtggcaggagggcaacgtgttcagctgcagcgtgatgcacgaggccctgcacaaccactacacccagaagagcctgagcctgagcctgggcaagggcagcggcgccaccaacttcagcctgctgaagcaggccggcgacgtggaggagaaccccggccccgagatcgtgctgacccagagccccgccaccctgagcctgagccccggcgagcgggccaccctgagctgccgggccagcaagggcgtgagcaccagcggctacagctacctgcactggtaccagcagaagcccggccaggccccccggctgctgatctacctggccagctacctggagagcggcgtgcccgcccggttcagcggcagcggcagcggcaccgacttcaccctgaccatcagcagcctggagcccgaggacttcgccgtgtactactgccagcacagccgggacctgcccctgaccttcggcggcggcaccaaggtggagatcaagcggaccgtggccgcccccagcgtgttcatcttcccccccagcgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaaccggggcgagtgctaa

SEQ ID NO: 15 - DNA, 435 bp, synthetic construct
  source 1..435: mol_type = other DNA
atgtggctgcagagcctgctgctcttgggcactgtggcctgcagcatctctgcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggagtga

SEQ ID NO: 16 - DNA, 156941 bp, synthetic construct
  source 1..156941: mol_type = other DNA
agtccccgtcttgccgcgcgggggcgggcgcgggaaaaaagccgcgcgggggcgcccgcgggaaggcagccccgcggcgcgcggggggaggggcggcgcccgcgggggagcggccggctccgggggagggacggggaagggggcgcgcggggctgccctgccgcccgcccgccgccgccgcccgccttcgcgcccccccccaaaaaacaccccccccgggggttgactccccgggggaaaagaggcggggcgggagtccccgtcctgccgccgccccttaagagggcccgcaacacggcccgggctgcgcacgccagccgggacgggtgagttcgctaggcaagcacggactggcggttacacggataacctggttctttccgcctcagaagccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagcatttaggtgacactatagaatagggccctctagctcgagctaatgatgatggtgatgatgtttcagctccagcttggtcccagcaccgaacgtgagcgggttactactccactgttggcagtaataagtggcagcatcttcagcctccatgctgctgattgtgagagagtatgaggtcccagacccactgccactgaagcgataagggactccagaagccactttggatgtgtcataaatccatcttttgggggaggtgcctgacttctgctggtaccagttcatgtaacttacacttgaactggctctgcaggtcatggtgaccttctcccctggagatgcagacatgattgctggagactgggtcagctgaatgtcgtcgactccacctgaacctccacttccaccagaacctccacttccaccttcgactgaggagactgtgagagtggtgccttggccccagtagtcaaggcagtaatgatcatcataatatcttgcacagtaatagactgcagagtcctcagatgtcaggctgctcagttgcatgtaggctgtgctggaggatttgtctgtagtcaatgtggccttgtccttgaacttctgattgtaattagtataaccacggctaggattaatgtatccaatccattccagaccctgtccaggcctctgttttacccagtgcatcgtgtacctagtaaaggtgtagccagaagtcttgcaggacatcttcactgaggccccaggtcttgccagttcagcccctgactgctgcagtttgatatccgacccaccaccggtccgcttgatctccaccttggtgccctggccgaaggtggcggggtggtacaggtactgctggcagtagtaggtggcgaagtcctcgggctgcaggctgctgatggtcagggtgaagtcggtgccgctgccgctgccgctgaaccggctgggcacgccgctgtacaggaagctggcgctgtagatcagcagcttgggggccttgccgggcttctgctggtaccaggccacggcggtgctcacgtcctggctggcccggcaggtgatggtcacccggtcgcccacgctggcgctcaggctgctggggctctgggtcatctggatgtcagatccgccgccacccgacccaccaccgcccgagccaccgccaccggcggcgctcacggtcaccagggtgccctggccccagtagtcgaagccgccgggccagtgccgccgggcgcagtagtacacggcggtgtcctcggcccgcaggctgttcatctgcaggtaggcggtgttcttgctggtgtcggcgctgatggtgaaccggcccttcacgctgtcggcgtagtaggtgctgccgccgtaggggctgatccaggccacccactccaggcccttgccgggggcctgccgcacccagtggatccagctgtcgctgaaggtgaagccgctggcggcgcagctcagccgcaggctgccgccgggctgcaccaggccgccgccgctctccaccagctgcacctcgcactgcacgcccttcaggatcagcaccaggaagatcaggctcaggccgaagttcatggatccagcttgggtctccctatagtgagtcgtattaatttcgataagccagtaagcagtgggttctctagttagccagagagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacgcgtatatctggcccgtacatcgatcatcgatgaattcgagctcggtacccggggatcctctagaccggcttcccggtatggtaattagaaacttttaataggcggtcccggccgccatccccgcgcatggtaattagcaacttttaatgggccggcgttcccgctcgcggtaattagcagcttttaacgggccgccattcccgcttatggtaattaaaaacgttcggacggcccctcgctccccgcgtaattactccctcggggttccgggttatgctgattactttcttggcagaacacgcagagcctcgcgcgccgccgggtgggtgggctgatcggcccctattggtcccctgggcttcctagtatgctaatgaatttctccccgggggcgggcaccactcagggccgcgccggcggggcgccggggggactcccatctgcgtcggcggggggcggcgcatgctaatggggttcttggagtacacccggttggtccccggggacggggccgccccgagagggggggattccctccctccgcccccgccggggcgcgcggctattgggggaatcgtaaatgccgcccctttgggggagtggataggcgccgggtataaggcagccccgtgtgacggtcgggccgcattcgcaccccggcactgcgagcgacggagcggcggcccggcgggaggaggagacccggagagacagagactaaaacccggcaagagagagaccgcgggccgccgtctcgagtctaccctaccccggctcatggaaccccggcccggcacgagctcccgggcggaccccggccccgagcggccgccgcggcagacccccggcacggtgagagggcgacccccgggtctcaggcccccccttttccccggaccacccggctgcgggttgggggtggtcgcgggcggtgggctcgggggcggggacgcttgacggggccgacccccggcccgcttaagcggtcgggggacccccgtgggccgtgcgccgccccccgaccctctgggggggcgagggaggcagggaggagcccgagagcgggggacagggggggagacgaggggtcggaatccaaaggacgcagaccacctttggttacggacccctttctcccccccttccgaacaaaaagcagcgggcggggggccggggtgagggagggacacgggggacacggcgcgggggtcccgcctcacgccccgcgccctctaaatcccccccgttgctttgtcaagcagcccgccgccccgcacgcctgggggatgctcaacgacatgcagtggctcgccagcagcgactcggaggaggagaccgaggtgggaatctctgacgacgaccttcaccgcgactccacctccgaggcgggcagcacggacacggagatgttcgaggcgggcctgatggacgcggccacgcccccggcccggcccccggccgagcgccagggcagccccacgcccgccgacgcgcagggatcctgcgggggtgggcccgtgggtgaggaggaagcggaagcgggaggggggggcgacgtgtgcgccgtgtgcacggacgagatcgccccgcccctgcgctgccagagttttccctgcctgcaccccttctgcatcccgtgcatgaagacctggattccgttgcgcaacacgtgtcccctgtgcaacaccccggtggcgtacctgatagtgggcgtgaccgccagcgggtcgttcagcaccatcccgatagtgaacgacccccggacccgcgtggaggccgaggcggccgtgcgggccggcacggccgtggactttatctggacgggcaaccagcggacggccccgcgctccctgtcgctggggggacacacggtccgcgccctgtcgcccacccccccgtggcccggcacggacgacgaggacgatgacctggccgacggtgagggcgggcgggggtcgggcgggggtcgggcgggggtcgggcgggggtcgggcgggggtcgggcgggggtcgggcgggggtcgggcgggggtcgggcgggggtcgggcgggggtcgggcgggggtcgggcgggggtcgggcactaaccgggggctcccgtctctgtctccctctgcagtggactacgtcccgcccgccccccgaagagcgccccggcgcgggggcggcggtgcgggggcgacccgcggaacctcccagcccgccgcgacccgaccggcgccccctggcgccccgcggagcagcagcagcggcggcgccccgttgcgggcgggggtgggatctgggtctgggggcggccctgccgtcgcggccgtcgtgccgagagtggcctctcttccccctgcggccggcggggggcgcgcgcaggcgcggcgggtgggcgaagacgccgcggcggcggagggcaggacgccccccgcgggacagccccgcgcggcccaggagccccccatagtcatcagcgactctcccccgccgtctccgcgccgccccgcgggccccgggccgctctcctttttctcctcctcctccgcgcaggtgtcctcgggccccggggggggaggtctgccacagtcgtcggggcgcgcggcgcgcccccgcgcggccgtcgccccgcgcgtccggagtccgccccgcgccgccgccgcccccgtggtgtctgcgagcgcggacgcggccgggcccgcgccgcccgccgtgccggtggacgcgcaccgcgcgccccggtcgcgcatgacccaggctcagaccgacacccaagcacagagtctgggccgggcaggcgcgaccgacgcgcgcgggtcgggagggccgggcgcggagggaggacccggggtcccccgcggcaccaacacccccggtgccgccccccacgccgcggagggggcggcggcccgcccccggaagaggcgcgggtcggactcgggccctgcggcctcgtcctccgcctcttcctccgccgccccgcgctcgcccctcgccccccagggggtgggggccaagagggcggcgccgcgccgggccccggactcggactcgggcgaccgcggccacgggccgctcgccccggcgtccgcgggcgccgcgcccccgtcggcgtctccgtcgtcccaggccgcggtcgccgccgccgcctcctcttcctcctccgccgcctcctcttcctcctccgccgcctcctcttcctcctccgccgcctcctcttcctcctccgccgcctcttcctcctccgccgcctcctcttcctcctcctcctcctccgcctcttcctctgcgggcggggctggtgggagcgtcgcgtccgcgtccggcgctggggagagacgagaaacctccctcggcccccgcgctgctgcgccgcgggggccgaggaagtgtgccaggaagacgcgccacgcggagggcggccccgagcccggggcccgcgacccggcgcccggcctcacgcgctacctgcccatcgcgggggtctcgagcgtcgtggccctggcgccttacgtgaacaagacggtcacgggggactgcctgcccgtcctggacatggagacgggccacataggggcctacgtggtcctcgtggaccagacggggaacgtggcggacctgctgcgggccgcggcccccgcgtggagccgccgcaccctgctccccgagcacgcgcgcaactgcgtgaggccccccgactacccgacgccccccgcgtcggagtggaacagcctctggatgaccccggtgggcaacatgctctttgaccagggcaccctggtgggcgcgctggacttccacggcctccggtcgcgccacccgtggtctcgggagcagggcgcgcccgcgccggccggcgacgcccccgcgggccacggggagtagggggagctaacactcggcttgctgcccaaagggaagccgccccccaccggaccaccggccgaggcgcctcgggggcagggggaggtgggggggaaagacggggaggagacaggaagtgggggtgggagtggggggggacggacacggccccgaacagcaacacacaccagcattttgttatggactttctggccttgttgaaaacttgaggaaaaaaaactttatatttataaaaattttacaataaagttttgtgatgcttttgacacactttgttgttggcctttgatgcagctcccccgcgcaggggggccggggatggggggggggaaagggaggaggaggagggggggcgggcacgagaagccgcccccacccccgaggcctgttggtctttatgatagaacagagccggggcccggcctgcgttctggctccctgtcttggtgggtgggcgggctggctggcgggtaaaaaaagagtgtgtccgtgttgacagggaggggggcccgatcgtgcagagcacgcacgtctggccggccagaccctgggggtggtgggcaggagtgggagggcgcctggctcggggagggaggagggggggggtcagccgcaccaccggcgcgaagccaggggccagggaactttgatagagagggggggaaagtggggcgggggcgagggcggttgaatcacaacgcatgcacgccctctgcccccggggacgggtgggaggaaggaggagggagaagagaagacccgaggcatgcacccgcacttacgcccgtgcccacccccgccccggcgcccaccccgcccgcacacctgcccgccacgcccgcccctcctcaccctggctgggagaaaggaggaggagcaggaagaggagacccgaggcatgcaaccgcactcaccccaccccgcccgcacacctgcccgccacgcccgcccctccttaccctggctgcggggagactcccatcggggcgagggggctcgcgcgttcgcaacaccacaccacaccacacggcccaccacaacacggcccaccacgacacaacacgacacgacgcgttttgcggggcatgcaagtcgacacaccgcgcgcgtgcctacctttccctagcggccccggcccccggcccgtttccttccgccaccactaccaccacccccccgcccgcgcccacgcggtagaggaaggggacgggcgccacacccacggctgtggctgggcacgcgcctttggggttgttgggggggggtgaccggcgcgtgggggcggtgggcgtatgggcccgacccgcgcctgccccccctgggaacgacgcccccggacgacaccacgggggggggaaacgggggtgggtggaagggaagaggaaggagaaagggggggtggatccgaacacgccggatccgcgaaaataataacaaaacaaacaaaaacagaaacaaaaacaaaaacacctagaaaaaaaggatacgggttggctcgcgggcggtgcggctgacctgcctgccctttctgggacccccgcctcgtgtttcttgaaagggggaggaagaacagttctcccccaacccctgctctcttctctcttccgcccgccccccccccctctcccgccgcctcagcagaagctcacctgtacgaccctaaacctacctgcgagaacgcgcggcgttcgaggggcgcgctctctcacacgagacacacgcaggcgccccccccccccggagcctgggtcccccggcggacggctcacgcggcgcggcgtctcggtgggacgcgggcagagggcggcggcggcgggggggggggggaaatgtgaggagagcgagacagagagagagaaggaagagggaaggggcgcggcgggacgggggaagacgaggagaagggaaggggcgagggtcgggcccgggagcggggcggccgggagggagaagaaacggaacgcggaaacgccgccggcgcggcccggggccccggggcccccgcgctccgccgggggcccgggccggaccgccgggcgggggacgccttccgcccggcgccgggcggctacccgggacccccggccgggaatcgaaaaaagcctccgggggcccctttcgcgcctttcgcgaacgcgcggcgccggagggggcggccgccgaggtgcgggggcccctccggccggggcgcacctcggcggccaagccccggcccgcccgggggtccccgaggcagaggcggaccctcggaggcgcggaagaagacgggaggcgggggaaaaaagggggaagagagggggaggtagggaggggagaggagaagggcgcgccggtgcgcggagcagccttccttctccggagtccctctcgatcggcggcgggcccctgcgttcgttgctgccgcgcccccggttttataaagacagggatgacgcagcagaaatgcccacagcaacacgcgggcggggctcgggctctccggcggcttaatggatctccgggcacggcgcccgcaaccgcagagcactcagctggcgcgcccccccccaacgtgggagtgtttaatggaagggcgtggggccggccgccggatgcccgcgggggcctaatgcggcgggaggcgtgggccgctggcgccgcggcccgtctgctggcccgcggcccgtctgctggcccgcggccacgtaaacaatgacacaggggttctctccgccgcggccggcgcggggcgttgccggcccggcccggccccggagcccgcggcgctgctcggctgcggccgcgggctccgggggctccgcactctgcccggctcgccccgtcccccctcttgctgcttttccgcgcgcctctctttcccgttgctttccctctccccccccccccctctctctctctctctctctctctccgccatcctcccgcccggccgcccactccccgctcggcctctccggctgcggtgcttgggtctccttcgtcgggcggcggggggggggcgtcgggactcgcggagggccggagaatggaaggcgaggggatgcaggaggaggatcgggactccccatcttctgcccttccatcctccgtttttccgctttccaccgccgccgccaccacccccccttccttcgcccgcccgcctcgccccggacccctcccccccgtgttccccccatcgttcaccaccacgccccccaccgcgccttggctgtttggggggtggcggcggtggtcggcgtgctgccggaggctgcgggcgcggggtaggtgggtgggcgggtggtgggggggggcccggctgcgtctcgccgcgatcccgccggtggggcgcggcggcggtcggggtggggggagagtgtcgtgggtgtgttttcgtgtcccccaccaccactcccaccccgaccgccgccgcgcccgcgtttctgccgcccgcgcgctcctgtgtggaccccggggtgggcggcggggggggggtgccgtgggtgtggcggcggggcgcgggccggggccggggctcgctggtccgccgaagtaaagaaaagatcgccaccgtgtgttcgtctgtgtgttctgcgcggcgccggggcccccctgccgggcggggcggtggggcggggccggggtcgcggcggggaaggaaggaaagaccccggaagcgccgggagggggcgccggcgcgacgcgggcggccgggcgggggcgcgcggcggccgggcgggggcgcgcggcggccgggcgggggcgcgcggcggccgggcgggggcgcgcggcggccgggcgggggcgcgcggcggccgggcgggggcgcgcggcggccgggcgggggcgcgctttccccgcgtcgcccctcgggttcccaagacctatcacgtgtgcgcaggggaggggaggacgcgggggaggggaggacgcgggggaggggaggacgcgggggatatataaagcggtagaaagcgcgggaatgggcatattggacccgcgtgattcggttgctcgcggttgtcttgtttggacgttttttatgcgggaacaagggggcttaccggttacactgtccgctcgctatggggttcgtctgtctgtttgggcttgtcgttatgggagcctggggggcgtggggtgggtcacaggcaaccgaatatgttcttcgtagtgttattgccaaagaggtgggggacatactaagagtgccttgcatgcggacccccgcggacgatgtttcttggcgctacgaggccccgtccgttattgactatgcccgcatagacggaatatttcttcgctatcactgcccggggttggacacgtttttgtgggataggcacgcccagagggcgtatctggttaacccctttctctttgcggcgggatttttggaggacttgagtcactctgtgtttccggccgacacccaggaaacaacgacgcgccgggccctttataaagagatacgcgatgcgttgggcagtcgaaaacaggccgtcagccacgcacccgtcagggccgggtgtgtaaactttgactactcacgcactcgccgctgcgtcgggcgacgcgatttacggcctgccaacaccacgtcaacgtgggaaccgcctgtgtcgtcggacgatgaagcgagctcgcagtcgaagcccctcgccacccagccgcccgtcctcgccctttcgaacgcccccccacggcgggtctccccgacgcgaggtcggcgccggcatactcgcctccgacgcaactagccacgtctgcatcgcaagccaccctgggtcgggagcaggacagccgacccgtctagcggccgggtcggctgtccagcgtcgtcgccctagaggctgtccgccgggcgtgatgttttccgcatctacgacccccgaacagcccctggggctgtcgggcgatgcgacgccgcccctgccgacttccgtgcccctggactgggccgcgtttcggcgcgcgtttctgatcgacgacgcctggcggcccctgttggagccggagctcgcgaaccccctaaccgcgcgcctcctcgcggagtatgaccgtcggtgccagaccgaagaggtgctgccgccgcgggaggatgtgttctcctggacgcggtattgtacccccgacgacgtgcgcgtggttatcatcgggcaggacccgtaccaccatcccggccaggcgcacggcctggcgtttagcgtgcgtgcggatgtgccggtgcctccgagtctacggaacgtgctggcggcggttaaaaattgttaccccgacgcgcgcatgagcggccgcggctgcctggaaaagtgggctcgcgacggcgtgctgttgttgaacacgaccctgaccgtcaagcgcggggcggcggcgtcccactccaagcttggatgggaccgttttgtgggcggggtggtccgacggctggccgcgcgccgcccgggcctggtctttatgctctggggcgcccatgcccagaacgcgatcaggcccgaccctcgccaacactacgtcctcaagttttctcacccgtcgcccctctccaaggtcccgtttgggacgtgccagcatttcctcgccgcgaatcgctacctcgaaacccgggacattatgccgatcgactggtcggtataagatgccgacatccggggtcttgatttacgagggggcaattaataaagactgttgatggttaaatctcgggtctcataccggtccgtgatgtcgggcgtgggggaagagagggtcccctctgcgtttactatccttgcctcgtggggctggacgtttgcaccccagaaccatgatcctggcgcgtcgccgaatacgacgcccatagagtcgattgcggggaccgcaccggacgcgcacgtggggcctctcgacggagagccggaccgggatgcgatctccccgcttacgtcgagcgtggccggcgacccgccgggggcggacggcccctacgtcacctttgatactctgtttatggtatcttcgatcgacgaactggggcgccgccagctcacggatacgatccgtaaggacctgcggctgtcgctggccaagttcagcatcgcgtgtaccaagacctcgtcgttttcggggacggccgcgcgccagcgcaagcgcggagcaccgccgcaacgcacatgcgtaccacgcagcaacaagagcctccagatgttcgttttgtgcaagcgcgccaacgccgcgcaggtgcgcgagcagctgcgggcggttattcggtcgcgcaagccgcgcaagtattacacgcggtcctcggatgggcggctctgcccggccgtccccgtgtttgtacacgagtttgtttcgtccgaacccatgcgcctccatcgagataacgtcatgctgtctacggaaccagactaagcacccccgccgtcccctttcttttccccctacccttccccccgttactgatgtgttgtgacgtttcaataaataacacgtagcttattttgttggatgatggattgattgattttattgaccgttcgttcgcccggcggtgccgtcgccgcgcgcagagggaatatgcaagcgggcggggtggggaggaaagaaggtttcaggttccgggggttgggtctgcgtcgtccagggtggggctgatctgaatttcccgcagaacctcgaccagtaggtctgttgtgtttgctgggaactcgcccgccgttggggatacgggggcggggggtgtggtcgggcggacgtccaggggtgcgttatcgcacccccgcgccgcctcgggggccgtcccgtagatcgttgcggtgatgtagatggtgtccggggtccacaccaccgtcaggatgccggccgtcgcactccggacgctttcgccgtgcgatgagctgacccaggagtcaaaggggtacgcgtacatatgggcgtcccaccagcgctccagcctctgggtactagcgcgtcctataaagcggtatgcgcaaaattcggcacgacagtcgataatcaccagcagcccgatgggggtgtgttgtatcaccacgcctccgcggggcaggcggtcctggcgcgctcgaccccgcgtcagaaccgcgcgcgtccctgactcaaacacgtgcaccacctgtgccgcgtccggcagcgcgctcgttagcgacgccctggggtgatgtaggctgtacgcgatggtcgtctgggggttccccatgtctcgggggggtgggggtgaatgtcacccggcccgggtgcggtgggaacgcgagggaatggagggttaatagacaatgaccacattcggatcgcgtagagcagatagtatgtgctcgctaatgacgtcatcgcgttcgtggcgctcccggagcgggtttagattcatgtgcaggaactcggatgaggtggtgcgggacatggctacgtacgcgctgtttaggcgcaggtttccgggcgtgaagcatatggcgaccttgtccagactgagcccctgggagcgcgtgatggtcatcgcgagtttggagctgatgccgtagtcggcgttgatggccatggccagctccgtggagtcgatcgactcgacaaactcactgatgttggtattgacgacagacatgaagccgtgctggtcccgcaggacgatgtagggcaggggggactcctccaagaactcggccacgccggccgtcgcgtgccgccgccgcagctcctccgcgaacgcgaacacccgggtgtacgtgtaccccatcagcgtgtagttgtccgtctgcagggccacggacatcagccccccgcgcggcgagccggtcagcagctcgcagccccggaaaatgacattgtccacgtaggtgctgaagggggcgctctcaaacacctccccgaagagctcccgtaggataaggtatcgccccagaaaggccctcttcaggagcccaaactgggcgtggacggccgcggtggtctcaggctcttcgagggcgtagtggcagtagaacacgtccagctgctgttcgtccagcccggcgaagataacgtcaaggtcgtcgtcggggaagtcgtccgggcccccgtcccgcgggcccaggtgcttaaaattgaacgcacgctcccccggagagcggtcgctggtgtcggcggccctggttgccgatgcgccggcggcgtcccggcgtagcgacaggagttctgccgtcagctcccctaggcggccgtaggccagggtcctctgggtcgcgtccaggccggggcgctggagaaagttgtaaaagtgaatcagcccgccgaacatgagccgcgacaggaaccggtaggcgaactccaccgaggtctccccctgggtcttcacgaagctgtcgtcgcgcagcacagcctcgaaggtccgaaacgtcccgtcgaacccaaacaccatctttcggaggcgcgcggtcaccgcgacctggctgttgaggacgtacgtgatgtcgttccgggccacgactagctgttgcttgctgtgcacctcacagcgcacgtgccccgcgtcctggtcctgactctgggagtagttggtgatgcgactggcgttggccgtgatccacttttccatggtcagcgtgggttgctgcgtgagccgtcgatactcgtcaaactctttgaccgacacaaacgtgagcacggggagggtaaacacaacaaactccccctcgcgagtcacctttaggtaggcgtggagcttggccatgtacgcgctgacctccttgtgggacgagaacagccgcgtccaccccggaaggttggccgggttggtgatgtaactttccgggacgacaaagcggtccacaaactgcatgtgctcctcggtgatgggaaggccgtactccagcaccttcatgaggttcccgaactcgtgctccacacatcgcttgttgttaatgaaaatggcccagctgtgcgagaggcgcgtgtactcgcgtagggtgcggttgcagatgaggtacgtgagcacgttttcgctctgccggacggagcatcgcagtttttggtgttcgaaggtggactccagcgaggccgtctgggtcggcgaccccacgcacaccagcaccggccgcaggcggcccgcgtactggggggtgtggtacagggcgttaatcatccaccagcaatacaccacggtcgtgagtaggtgccgccccaggagcccggcctcgtcgatgacgataatgttgctgcgggtgaaagccggcagcgccccgtgtgtgaccgaggccaggcgcgtgagggcaccctggcccagccccaaagtctgctctagggcggtgagggcgtggaactcgtttcgcgcgtcttcgcccccgtgcgccgccagggcccgcttggtgatgtcgaggatcacctcccagtagtacgtcaggtctcgccgctgcaggtcttccagcgaggcggggctgctggccagggtgtacgggtgctgccccagctgggcctggacgtgattcccgcgaaacccgaactcgtgaaagatggtgttgatgggtcgactcagaaacgcccccgagagcttaacgtacatgttctgcgccgcgattcgcgtggcgcccgtgaccacgcagtccaggacctcgttgagggtctgcacgcacgtactctttccggatccggcgttgccggtgatgagatacgccgcgaacggaaactcccggagcggcaggccggtcgggacctccaaggccgccacgtcccggaaccactgcaggcgcggcacctgcgtgacgtcgagctgctgctgcgagagctctcggatgcgtgcgatgattggttggaccccgtgcatggacgtaaaatttaaaaacgcctcgtccctgaaccgcacggcgggtctggccccgggctgctgtgggggcggacctggtgcccggacgtcccgcgagccctccccgccggacgccgccatggccgcacagcgcgcgcgggcgccggcgatgcggacgcggggcggcgacgcggcgctatgcgcccccgaggacggctgggtgaaggttcaccccacccccgggacgatgttgttccgcgagattctcctcgggcagatggggtacaccgagggtcagggggtgtacaacgtcgtccggtccagcgaggccgccacccgacagctgcaggcggcgatcttccacgcgctcctcaacgccacgacgtaccgggacctggaggaggactggcgccgccacgtggtggcccgcggcctccagccgcagcggctggttcgcaggtaccggaacgcccgggagggcgatatcgccggggtggccgagcgggtgttcgacacgtggcgatgcacgctcaggacgacgctgctggactttgcccacggggtggtagactgctttgcgccgggcggcccaagcggaccgaccagcttccccaaatatatcgactggctgacgtgtctggggctggttcccatattgcgcaagacgcgcgagggggaggcgacgcagcgcctgggggcgtttctcaggcagcacacgctgccccggcagctggccacggtcgccggggccgcggagcgcgccggcccggggcttctggatctggccgtcgcgttcgactccacgcgcatggcggaatacgaccgcgtgcacatctactacaaccatcgccggggggagtggctggtgcgcgacccggtcagcgggcagcgcggcgagtgcctggtgctgtgcccccccctgtggaccggcgaccgcctggtcttcgattcgcccgttcagcggctgtgccccgagatcgtcgcgtgccacgccctccgggaacacgcgcacatctgccgtctgcgcaacaccgcgtccgtcaaggtgctgttggggcgcaagagcgacagcgagcgcggggtggctggcgccgcgcgggtcgtcaataaggcgctgggggaggatgacgagacgaaggccggctcggccgcctcgcgtctcgtgcggctcatcatcaacatgaagggcatgcgccacgtgggcgacatcaacgacacggtacgcgcctacttggacgaggcgggggggcacctgatcgacacccccgccgtcgaccacaccctccctgggttcggcaagggcggcaccggccgcgggtcggcgccccaggacccgggggcgcgaccgcagcagcttcgccaggcgtttcagacggccgtggtcaacaacatcaacggcatgctggagggctatatcaataatctctttggaaccatagaacgcctgcgagagacgaacgcgggtctggcgacccagctgcaggcgcgcgaccgcgagctgcggcgcgcccaggcgggggcgctggagcgggagcagcgcgcggcggaccgggcggccgggggaggcgcgggccgcccggcggaggcggatcttctccgggccgactacgacattatcgacgtcagcaagtccatggacgacgacacgtacgtggccaacagtttccagcaccagtacatccccgcgtacggccaggacctcgagcgcctgtcgcgcctctgggagcacgagctggtgcgctgcttcaagattctgcgccaccgcaacaaccagggccaggaaacgtcgatctcgtactctagcggggcgatcgcctccttcgtggccccgtatttcgagtacgtgcttcgcgccccccgagcgggcgcgctcatcaccggctccgatgtcatcctaggggaggaggagttatgggaggcggtctttaagaaaacccgcctgcagacgtacctgacagacgtcgcggccctgttcgtggcggacgtacagcacgcggctctgccccggcccccctccccaacccccgccgatttccgggcgagcgcgtccccgcggggcgggtcccggtcccggacccggacccgatcccggtcgcccgggagaacgccgaggggtgcgccggaccagggctggggcgtcgaacgcagggatggccgaccccacgcccgccgatgagggaacggccgccgccatcctcaaacaggccatcgccggggaccgcagtctggtcgaggtggcggaggggatcagcaaccaggcgctgctgcgcatggcctgcgaggtgcgccaggtcagcgatcgccagccgcggtttaccgcgaccagcgtcctgcgcgttgacgtcacccccagggggcggttgcggttcgttctggacgggagttccgacgacgcgtacgtggcgtcggaggattactttaagcgctgcggggaccagccgacgtatcgcggttttgcggtcgtcgtcctcacggccaacgaggaccacgtgcacagcctggccgtgccccccctcgttctgctgcaccggctctccttgtttcgccccacggacctccgggacttcgagctcgtctgcctgctgatgtacctggagaactgtccccggagccacgccacgccctcgctgttcgtcaaggtgtcggcgtggttgggggtcgtggcccgccacgcgtctcccttcgagcgcgtccgctgccttctcctccgcagctgccactggatcctgaacacgctaatgtgcatggcgggcgtgaagcccttcgacgacgagctagtcctgccccactggtacatggcccactacctgctggccaacaatccgccccccgtcctctcggccctgttttgcgccaccccgcagagctctgcgttgcagttgcccgggcccgtcccccgcacggactgtgtggcctataacccggccggcgtcatgggaagctgctggaattccaaggacctgcgttcggctctggtgtattggtggctttcggggagccccaaacgacggacctcgtcgcttttctatcggttttgctaactccggaaaataaacgtgttttttatggaacgttccccacctgtcgtgtcatctctcgggggatggtggtgggcctgtgtgtgtgtcttgtgcaccgaaggaggaaagtgggggggtggtggtgctggtggtggaaagacatgatagagggaacaaagaaatagaagaaaaccacaaccggcgcgtgccagtaaatacggacgcgcgcacacgcggggggtaagttggagcacggggccccggtttattgaccaaattcagggaaacagaaaccgcatcttttcctcgaaagggtacacaaagctcccgccctcgccccacacgccttccagaacccccgtaaacaccagttgaatctcgcgcaggatctcgcgcaggtgatgggcgcagtccacgggggggagcaccaagggccgcgggtacagatccacggggacgccgaccgactccccgcccccgggacatacgcgcacgacgcgtctccagtattgctccgcgtccagcagggcgcctccgcggaaggccgtttggggcagggggtcgtcggcctcgcctgggggggtcagaacgctccagtactccgcgtccagacgcctcccgaaggcatccaggacaaagcggtcacaggcgtcctccatgacgccccgggccgcgcacacggcctcctccggcgggccggcggccggccgccggaggattcgtctcagcgcgtcgcgcataacctcggccgccgcggcgtacgcgggcccgcggagaggaaatccctgcaggaagtcggtgtcatcgcgggagttccagaaccacgccccggtctggctccaggtgacgacgtgggtgtagacgccctctggcgccagggagggggcgaggcgcgggcgtatgccgttggccgaaagtacggcgcgcacggacgcctcgagggcccggcgggcgtcctggatcgcgccgtgcgcggcgtccgcgtccccggggtccacgttgaacagcccccagaacgcagccccggtgccgccgcagaccgcaaacttcaccgagctggccgtctgctcgatctgcaggcagacggcggccatgaccccgccgagcagctgccggagcgcggggcaggcgtcgcacgcgtccggcaccaggcgctccagcacggcccgggcccagggctccgagggggcggccgccaccagcgcgtccagcctttccaggcccgcccgcccccgggcttccggcagcccggcctccccgaggcccgcgagggcggccaggagctgggcctggagcccggagaaacaaaaccgcgccgtccagaccggcccgacggccgccggggggtcgagtagttggatggtggtggccgtggggtgccaccgcgccaccgcttcccgaaaggcgggcaggaggcggccggccgcctccgaggccacggccggccatgcccgcgggggcaggacgaccctggcgcccaccgcgggccaggcccccaggcacgcggcatgggtggccgcggcgccccgcaccaggtcacgcgccgactcggcggcggcggcggccggcacggtaaacgtgggccagcccggaaatcccagcacggcaaagtattggacgggccctccccggacctcaaacccgggccccagaaaagcgaagacgggggccagggctccgggggcggcgtggaccgtggtatgccactgccggaagagggcgaccagcgccggggcggagaacccgtcgccggcgctcacgaagtagtcgtagccgcgcggcagcagcacccgcgccgtgacccgctgcgggtgtccgcggggccgcaggccgacctcgcacacctcgaccaggtccgcgaaggcgccctccttcctggtcggcggaaacgccagggtggtgtattcgcgcgcaaaacgcgcggtcctcgtcgtgatggtgacggcgagcgaggcggaggacgcgcactgggggctgtcgcgaatggcggccaggcgcgcccacgccaaccgcgcgccggggtgctcggcgacgcgcgcggacagggccagcgggtcgacgtcgaccttggcctccacgtccaggagggcggcgcgaggagcggccggcgggccccacgacgccctttcgaccctcacgaccagacccgtctgcgggtcccagcccaggcgcagcgggacgaagagggccaccggccccgtctggcgctccagggccgccagaacgcacgcatacagcgcccgccacagggtcgggtcccccaggggctccagcggggaggcggccggggccgtcgcggcgcgggcggccgcgacggccccggcggccgagacgtcgggggagccgtagaagtcctgcaggtcggacgaaccaacggacacctccgcgaagcgcgcgcgcgcctcccccgcggcgtcgcgacagaccagatacagcagggcgtggaggcagtcgcgcgtgcgcgggggcagccataccgcgtatagggtaatggcgctgacgctctcctccacccaaacgatgccgggggcttccatgccacgacgcccgggggttgccgtgtatcgaacgagcgcggccccagacttatagggtgctaaagttcaccgccccctgcatcatgggccaggcctcggtgggaagctccgacagagccgcctcgagaatgatgtcagtgttgggctgggcgccggaggcgtgcgtgcgcaagcagcgcccccacgcgggcgcgcgcagcttgaagcgcgcgcccgcaaactcccgcttatgggccatcagcagcgcgtacagctgtctgtgcgtccggcaggcgctgtggtcgatgcggtgggcgtccagcagctccacgatggctcgcttggtgaggtttttaacgcgccccgccccgggaaacgtctgcgtgctcttggccagctgcaccccgaacagttcgccccagatgatcttgaacagcgacagcgcgtgctccgtctcgctcacggacccgcgcggggggcagccgctcagggcgtcggccacgcgcttaaccgcgtcctccgacagcaaggggccgtcggtcacgttacagtggcccagttcgaacaccagctgcatgtagcggtcgtagtgggggttcagcagctccagcacgtcctcggggctaaaggttcgccccgaccccccggccatcgagtcccactgcaggcacgcggccatggtgctgcacagacggaacagctcccagacgggggcgacgtttagggtggggtgtagggccacaagctccagctctccggcggcgttgatcgtggggatgacgcccgtggcgtagtggtcgtaaagccgccggaagatggcgctgctatgggcggccatggggacgcgaagacaggcctccagcagcaccaggtagatgaaccgcgtgcggccgaccaggctgttgaggccgcgcatgagcgcgaccacctcggccggcgcgacgtccggccggaggtacttttcgacgaaaaggcccacctcctccgtctcggcggcctgggccgacagggacgtgtcggggtcctggcagcgcagctcccgcagatcccgctgggccctcagggcatcaaaatgtatcccccgcaaaaacagacaaaagttcctcggggtcagcgcggcgtcgtggccccagaaccgcacgtgcatgcagttgagggtcagaagcatgtggaggatgttaagactgtccgcgaggcacgccagcgtgcacctctcgaagtagtgcttgtaccggaatttgctgtagatgcgcgacccccgcgcctgcgccgcgtcggcgtgcgacgcgtcgcagcgccctttgaaccggcggcacaacaggttcgtcacctgggaaaactgtgccggccactgcccgctggcgctcaccacgtggttgagcagcatgggcgtaaagacgggctccgagcgcgccccggacccgtccatgtagatcagcagctcccccttgcggagagtccgtacccgccccagcgactggtacacggacaccatgtccggcccgtagttcatgggtttcacgtaggcgaacatgctgtcaaagtgcggcggatcgaagctaaggcccaccgtcacgaccgttgtgtagatgaccacccggtaccggccccatgtggtcacgtcgccgggcggggtgagcgagtggagcagcagcacgcggtccgtaaactgccggcagaacctggcaacgacctccgcgaaggagaccgtcgacgagaagatgcagacgttatctccgccggccaggcgcgcctccagctccccgaagaaggtggcgtccgggggggcgtccggggggggcgccccgcccgccggccccggcgggcgcagggccgcctgcaggacctcgggccccaggcgcgggagaaacagacaacggcgcgccgaaaatccgggcatggcgtactccccgatgaccacgtgaacgttcttttcgccccggaggctgcacagaaagtccaccagctgcgcgttggcggtggcgtccatggcgatgatccgcgggcacgtgcgcagcaggcgcagcatcaacgcgtcgacgcggcccagctgctgcatcgtcggcgagtacagttggcccaacgtcgacatgacttcgtccaggacgagcacgtcgtagttgttcaacaggttcgggcccacgcgatgaagactttccacctgcacgatgagacggtggaaggggcggtcgttcatgatgtaattggtggatgagaagtaggtgacgaagtcgggcaaccctgactcagcgaaccgcgtcgccagggtctgagtaaaactccgacgacaggagacgaccagcacactcgtgtccggagagtggatcgcttcccccaaccagcggatcagcgcggtagtttttcccgagcccattggcgcgcggaccacagttacgcaccgggccgtcggggcgctcgcgtccgggaaggtgacgggtccgtgttgctgccgctcgatcgttgttttcgggtggacccggggaacccactcggccaaatcccccccgtaaagcatccgcgccagcgatacactcgacgtgtactgctcgcactcgtcatccccgatgggacgccgggcccccaggggatcccccgaggccgcgccgggcgccgacgtcgcgcccggggcgcgggcggcgtggtgggtctggtgtgtgcaggtggcgacgttcatcgtctcggccatctgcgtcgtggggctcctggtgctggcctctgtgttccgggacaggtttccctgcctttacgcccccgcgacctcttatgcgaaggcgaacgccacggtcgaggtgcgcgggggtgtagccgtccccctccggttggacacgcagagcctgctggccacgtacgcaattacgtctacgctgttgctggcggcggccgtgtacgccgcggtgggcgcggtgacctcgcgctacgagcgcgcgctggatgcggcccgtcgcctggcggcggcccgtatggcgatgccacacgccacgctaatcgccggaaacgtctgcgcgtggctgttgcagatcacagtcctgctgctggcccaccgcatcagccagctggcccaccttatctacgtcctgcactttgcgtgcctcgtgtatctcgcggcccatttttgcaccaggggggtcctgagcgggacgtacctgcgtcaggttcacggcctgattgacccggcgccgacgcaccatcgtatcgtcggtccggtgcgggcagtaatgacaaacgccttattactgggcaccctcctgtgcacggccgccgccgcggtctcgttgaacacgatcgccgccctgaacttcaacttttccgccccgagcatgctcatctgcctgacgacgctgttcgccctgcttgtcgtgtcgctgttgttggtggtcgagggggtgctgtgtcactacgtgcgcgtgttggtgggcccccacctcggggccatcgccgccaccggcatcgtcggcctggcctgcgagcactaccacaccggtggctactacgtggtggagcagcagtggccgggggcccagacgggagtccgcgtcgccctggcgctcgtcgccgcctttgccctcgccatggccgtgcttcggtgcacgcgcgcctacctgtatcaccggcgacaccacactaaatttttcgtgcgcatgcgcgacacccggcaccgcgcccattcggcgcttcgacgcgtacgcagctccatgcgcggttctaggcgtggcgggccgcccggagacccgggctacgcggaaaccccctacgcgagcgtgtcccaccacgccgagatcgaccggtatggggattccgacggggacccgatctacgacgaagtggcccccgaccacgaggccgagctctacgcccgagtgcaacgccccgggcctgtgcccgacgccgagcccatttacgacaccgtggaggggtatgcgccaaggtccgcgggggagccggtgtacagcaccgttcggcgatggtagccgtttcgttcgttttaataaaccgacgttgtgcgtttcaccatacttcggcgcgcgtgtgtgtgtgtttttttttttgtggtgtttattttccccccaccccttccttttctttcggccaccacccccctcctcccccgtactatacaacaaaaaataccacacatacgaccaaatacggacaatcatttctgtctttattcgctatcagagagtgggggcgtgagcgtggcaggagggcgggccacgtcggggtcccgccgtctggtgtgacgcgatggggggtccgatgcgcgccggtactggggccccggcgcccgggtgaccacgcgcacgtcggggggcacgtagaagttaccctcttcttcggactcgatgtccacgacgtcaaattcgtgggcggtcagcgagacgacctccccgccgtcggtggtgatgacgttgtgtcggcagcagcagggccgcgccccggagaacgcgaggcccataacttggcgagcgtatcgtcgaaggccaggcggctgtttcgccggatgtcccggtagatccccggctcgacgcggacgggggtgatgatcagggcgatcggaacggcctggtccgggaggatcgatgccttggcgggtccgggggccccgccacgcccggcgggcgctccgcggccgtcctccaggcggaacgtcacgccctcctccgcgcccgcgcggtgcctgccgaggaacgtcaccaggtgcggttgcagggggcagtcgggaaagtggctgtcgaggacgtatccctgcaccaagatctgtttgaagttcgggtggcgggggttggcgaagatgggctcgcggcgaaccagctccccggagctccaggccacgggagagatggtgcgacgctcaaggtcggggacgccaaacagaagcacctccgagacaacgccgctatttaactccaccagcgcccgatccggggcggagcatcgccttttttcgccggcggcgcgggaatcgagccagtcccggtcttgggtgacgagcgcctcctccgggcccggaacgcgcccgggcgcgaagtagcgcacgccggggttggggatggaccggatgaacgcccggaacgcctccggcgatcgccgcgccatcaggtcctcgtacgcggaggccgcgggggcgccggggtccgcggggtcgaacgcgtacttggctcggcacttaacctcgtagaaggccaggggggtctggggggcgggggccaggtagccgtgagggtccctggggcacacgaggatgtccagggacgcccccaccatgcccgtgtggccgtccatgaggaccccgcacgcgtgcacgttctcctcggcgaggtccccgggttggtgaaagacgaagcgcccggcgtcggcgtcgtcgttgacgcccgcgtccgcgcggcccacgcagtagcgaaacagcaggtttcgggccgtcggctcgttcacccgcccgaacatcaccgccgacgactgggcgtccagccgcaggctggcgttgtgggtgagccactgggacgagaagcacggaccctgcgcgccccaccgcagcgtggaggcggtcgtcaggccccgccgaagcagggcccagagctggcagtcggcctggttttgcgtcgccgcctcgtaaaatcccataagcgggcggggggcgacggcttcggcggcggacgggggggcgcggcgcgtcaggcgccagaggtgccggccgagcccgcggtccaccatgccggccgcctccagcgacacgacgagggagcacagatagtccaggcgagcccacaggggcccgatggccagaggggagcggacgccgcgcagcaggccgcgcaggtggcgctcgaacgtttccgccaagatatgggggggcagtgcgttggggatcgccgacgccgaccacatcgggtcggggtccgggggaccggggctgcagtccgggtcgatggcgtgtgcgccccccggcgagaggggaatgtcgggggttggcgggccggatgaggcctcagagagggccggggacgcgggccgggccttttcgcccggggccccgccgtcgggttgcccacgtggggggctctggggccaatgggaacccggggcccccggtgacgtggggcggggtggggcggggcggggcccaaagacggtcgccagatctaggctgttgggtcggggccgcttcgggggactatcggggtcgcgggcggggtccgcggggcgcttggcgccgggtgttgcggcggccgccatttttacgagcagccgaagagctcgagggcggaagggatcctcacgacagagagtggcgcgcggccgggttggcgtgacagaggcgggagaccagcaccagcagcggcctcagctcgggcggcagcgacaccgacgacaggacggccttgtgcgtgcgctggtaatttatacactgctccgtgaacgcgcgccgaatcttgggattgcgaaggtggcgccggatgccctccggcacgtcatacgccaggccgtgggtgttggtctcggccgagttgacaaagagggcggggtgcagaacgcagcgataggcgaggagggccacggcaaagtccggcgagagctggttgttaaagtactggtagcccgggacgcgggtcacggggacgcccaggctcggggccacgtacacgctaaccagcagctccagcagcgtctgccccagggcgtagagatcgaccgccagcccgacgtcgtgcttcagggggcggttgttaaactcggcccgctcgttgttgaggtactttaccgagagctccggtggctggttgtacccgtgccccaccagagtgtgaaagttggccgtggtcagggcggcgggcatcccaaacccccggggggactcgaggtccggctcctggaggcaaaactggccccgggatatcgtggagttggagttcagggtcaccaggctaaagtcggccaggacggcccgccggagcgacaccgcgtccgatcgcagcatcacgaggacgttggcgcacttgatgtccaggtggctgatcccgcacctggtgttcaggaacaccacggcgcgcgccaggtctgtgaagcagtggtggagggccgtcgcgacggagggggtggtcgcgcgcagggacgccagctggccgatgtacttgccgaggtccatgtcgtacgcggggaacacgatctggcgctgctgcagcgagaacccgagcggggtgataaagccgcggatgtcgtgggtgcggccgccgcgaagagcgcactcccccacgagcagggtcgcgacgagctccacggcaaaccactctttttcccggatggtcttcacggcgagcttgtgttcgcgaatcaactgcacctcgccgtacccccccgagcccccgaagctgcgggccccggggatctccagggtcgtgtagcggagggcggggttgacggcgaatacggggatgcatagcttgtggatgcgcgcgagggacaggatgtgcgaggggggcgacgggggcgaggtcatggccgtctcggacctgcgcaggggcgggcgccttagcttggccgcagggccgggggcctcgggggacgagcggcgacgagacgagcggctcactcgccatcgggacagtcccgcgcgaagccgctcccggaagctggatcggcggcgggacccggggcgggctccggagacggcgccgtctcggggggaggggccgcttgggcgtccggacgcccggcggctgagggagtgtatgtaggacgcgagccaggccttgaaggagcgtcggtgtgcaccttgggggctgatgtcagctgccacatgactagcaggtcgctgtcgcccggactcatccatccgtccgccaggtcgccgtccccccacagagacgcgttcgccgcggcctcttcgagctgctcctcctggtccgcaagacgatcgtccgccgcgtccaggcgctcgctaagcgcgggatcgaggtaccgtcggtgtgcggttagaaaatcacgtcgcgccgcttgctcttccacgcgaattttaacacaggtcgctcgctgtcgcatcatctctaagcgcgcgcgggactttagccgcgcctccaattccaagtgggccgccttggcggccataaaggcgccaacaaacctaggatcttgtgtactcacgccctcccggtgtagctgcagggtctggtccctgtacacctcggcccggaggtgcgtctcggccaaacgtcggcgcagggccgcgtggctggcgtctcggctcatctcgccgcccccgcgcgcgcccgacgtcggactccttcgccccgacccccctgacctcagccgcccccgcctcgcccgcgatgtttggccagcagctggcgtccgacgtgcagcagtacctggagcgcctggagaaacagaggcaacagaaggtgggcgtcgacgaggcgtcggcgggcctgacgctcggcggcgatgcgctgcgcgtcccttttttggattttgccaccgcgacgcccaagcgccaccagaccgtggtcccgggcgtcgggacgctccacgactgctgcgagcactcgccgctcttctcggccgtcgcgcggcggttgctgtttaatagcctggtgccggcgcaactcagggggcgtgactttgggggcgaccacacggccaagctggagttcctggcccccgagctggtgcgggcggtggcgcgcctgcggtttcgggagtgcgcgccggaggacgccgtgccccaacgcaacgcctactacagcgtcctgaacacgtttcaggccctgcaccgctccgaagcctttcggcagttggttcacttcgtgcgggacttcgcccagttgttgaaaacctcgttccgggcctctagtctcgcggagactacgggccccccgaagaaacgggccaaggtggacgtggccacccacgggcagacgtacggcaccttggagctcttccagaaaatgatactaatgcacgcgacctactttctggccgccgtgctgctcggggaccacgcggagcaggtcaacacgttcctgcggctcgtgttcgagatccccctgtttagcgacacggccgtgcggcacttccgccagcgcgccaccgtgtttctagtccccaggcgccacggaaagacctggtttttggtgcccctcatcgcgctgtcgctcgcgtccttccgggggatcaagataggctacacggcccacatccgcaaggcgaccgagcccgtgtttgatgagatcgacgcctgcctgcggggctggtttggctcgtcccgggtggaccacgtcaagggggaaaccatctcgttctcgttcccggacggctcgcgcagcacgatcgtgtttgcctccagccacaacacgaacgtaagtacgccttcctcccgcggtgcctgtttccccggtgccgccctccccgagatcgaccgacagacaaacacagccagacgcgagtgtgggacgacacgcccgcagccccccccccgccatggcgggggggaagccttactgtttatttgtaatcggacgatgaggctctggccacggcccgcgcgaccgcggggcagctcgttgcaaacaggcggctggtatacgatgacagaacgcagaggcgccacccggcgctggtcgggcggatgacgctttccgcgccgtcccggcccacgacgacctcgtgcaggtgggccgtgatgcgcgggcggcgggtcgcctgccgcaggataaccgcgtccacggggtgcccgaagaggagctgacacaggctcgcgtccccccggacggccagggtgcgctgggccatattggaccacatgcacggggcgacgcagggacaggcctccgccacggcgggggcgcgccacagcgcgttggcggaatcgatgtgggccgtcggggcgcaggcgccgcctcctcccggggggtcggtaatcctggatagcagccatcctaaatggcgggcccggctgcccgggggacagagcgaccccaggtcatcatccatggcccagcagtatatgcggccgccggggaggtgccaccaggcccccggacccagggcacagcacgcccccggattcgggggcggttccgtgggtaccaggtaggcgccgtcgagctcgtgggccacgggctcgtccgcgagctgttcggcggcggggtcgggggtttcctccgggggggaggcagcttccaggtggccgaaggctagggtgcacagcagcggggtccgggggtgcgttacgctgcggaggtggacggtggcgcagtagcggcgctcgcggttaaagaagaaaatggcaaagaacgtgttcgaaggcaggcgcagcgccttgggccgcgtcaggtacaggaagatctcgcagaaaagggcacgctcggggtcggggtccggaagggccacctggcacagcggctcggtgaggaccgtgaggcaccgaaaaatcttaagccgctcgtccccccgaacgacgcgccacacgaagacagagttggcgatgcgcgcgacgaggtcggcttcgggccccgggtcgggggcgcgcgcgtcggggggggcgccccggtgacccggcggggccgcggctcccggggggcctggcgtcgcctggggacgccagagtgcccgctgtgccaggttggtggtggggaagggaccggagacgcaccaaaagcagaggggccagcgcgtgtatgagttggggggggggtgggtgagcggtggaacaaaagcacgcgtcagcggacaaggccgggtcccgtagccgccccgcgacagaaccggagtccgacggcacgcgcgacggggtctgcgaggctgaggtacgccgcggtgttaatggtaaacgcaaagcctcccggaaagaccactagcccgcagaggcggcgattgaacccaaggcagaggtacgcgtagctctctcccggaaggtattgctcgcagaccctgtgtggggcagtggaggggctgccctccatgaagcgacatttactctgctcgcgtccattgacgtcaccgtcaatcaccactgcgattggacggttggtgaggcgcagcgtgtctccgctggtgctgtagtagtcaaacgcgtagtgggcgtcggagtcggcgaagcgggcggggatgtcgtcgctgagagggacgagccgccgccgccgcccccgaccgccctggccgcccagatgcgccagcacggccagggcgtacgcggtgtgaaagaacgcgtcgggggcggtcccctcgagggcgcgcatcaggttctccaggagcacggggaagcgccgcgtcacctcccctagccactcgctctggtgggggccaaagtcgtagcgcaggcgctggaagatgcgcgggccgccttggagcgcggcccggatagagtggcccagggcccgcagacacgcgatctggatgcgcgcgacgaaggccacctcggccgcgatgtcaaagggctgcagcacggggcgcgggtggcgcaggggtccctcgagcgcgggaaagcgacgcagcagcgccgtctgggccgcgggggacagctggtgggggcgcacgacgcgctcggcggcacaggcctccgtcagggccgtggccagctcggaggacagccgcggggggcgggcgcgtcgcccgccccacgccaccgaattctcgtaggagacgacgacgaagcgctgcttggtcccgtagtgatggcgcaggaccacggagatggagcgacggctccacagccagtcgggccggtcgccgccggccagagcttcccacccgcggtccagccactcgaccagcgatcgcggcttggcggtccccggcacgagggtgagcacgtcgttgaggacgtcctcgcccgcggcccgggggccccccggggtggcaaagcgccccccgccgggcggctccaggcccgccagcaccgcctccgcgtccgacgcgcccagggctcccccgctgacggcctggtggaccagggcgccctggcggagccccgaggcgacgccggaggccgcgtgcttggggcgcgcgcggaccgggtggcggcgggtgacgtcctgcacggcccgctggaccagcgcgaggatctcctcgttctcttgcgtgatggacacgtcctccgcggtggccgtgtcgcctcccggggccgtgagctgctcctccggggagatgggggggtctggggtgccgacaacggccggcccggccccgcccgagaccgaggacgcctggggagtgggggtgccgctttcccccatccccagggacaggtgggccgccgcctccgtcgcggcggcgggagccgcggcccccagccgcgcgacgtagcgacaaaagtggcgacagaggcgcatgaggcgcgcgccgtcggccgcgtatcgcgtgtttggcgggacgagctcgtcgtaactgaacaggagcacgcgggcgcaggtcgcccacgggccccacgccaggcgcagcgccgcgaccgtgtacgggtcgtacacgccttgggcgtcgcacgcgaccggcagggagacgaacagcccgcccgcgctggggacgcgcggcaggaggtccgggtgcgccgggatgacgggggctaggatcgcccccaccgcatccgccggcacgtaggcggcaaacgccgaacgccacggggtgcagtcgccggtcgcgtgggcccgggtctgggtttcgacccggaagttcgcggccgccccaccgtcggggcggccgcgcacgagggcggacagcgggacccccgccgccgccaggcactcgctggagatgatgacgtgaatcagcgaggcggggctgctcgggtcccgggtgagatcgtattggacctcgttggcaaagtgcgcgttcatggcccggccggcggtgcgagcccttcccggtgccggaaggggcgtgggtggggggtgcgtgtgcgcgtcctcggggcccgcgggcgcacgtgcgcttatacgctgtgtgtttcgtctgtccccagggaatccggggccaggactttaacctgcttttcgtcgacgaggccaactttattcgcccggatgcggtccagacgattatgggctttctcaatcaggccaactgcaagatcatcttcgtctcgtcgaccaacaccgggaaggccagcacgagctttttgtacaacctccgcggggccgccgacgagctgctcaacgtggtcacctatatatgcgacgaccacatgccgcgggtggtgacgcacaccaacgccacggcctgttcctgctatatcctgaacaaacccgtgtttatcacgatggacggcgccgttcgccggacggccgatctgtttctgcccgactccttcatgcaggagatcatcggggggcaggcccgcgagaccggcgacgaccggcccgtcctaacaaagtcggcgggggagcggtttctgctgtaccgcccctccaccaccaccaacagcggcctgatggcccccgagctgtacgtgtacgtggacccggcgttcacggccaacacgcgcgcctccggcaccggcatcgcggtcgtcgggaggtaccgcgacgatttcattatcttcgccctggagcactttttcctccgcgcgctcacgggatcggcccccgcggacatcgcccgctgcgtcgtgcacagcctcgcccaggtgctggcgctgcaccccggggcgtttcgcagcgttcgcgtggcggtcgagggcaacagcagccaggactcggccgtggccatcgccacacacgtgcataccgagatgcaccgcatcctggcctcggcgggggccaacggcccggggcccgagctcctcttctatcactgcgagccgcccggcggcgcggtattgtaccccttctttctgctcaacaaacagaagacgcccgccttcgaatactttatcaaaaagttcaactccgggggcgtcatggcgtcccaggagctcgtctccgtgacggtgcgcctgcagaccgacccggtcgagtatctgtccgagcagctcaacaacctcatcgaaaccgtctctcccaacaccgacgtccgcatgtactccggaaaacgcaacggtgccgcggacgacctcatggtcgcggtcatcatggccatttacctggcggccccgaccgggatccccccggccttttttccgatcacgcgcacgtcttgagtctttcttgccgtttcttttgtttctctttctttccccccctctctccgcaataaacgccttcccggaactgtgtttccccccctacaacagtgttgtccgttggttgggtggttggggtgcgggggtgggcgggggaagcaagaaaacggtcggcgaacacaacatcgggaaaacggattcccgcacgtgcgtcttcccagattcgacacacacaccccccttctccttaaataaacacaaaccacacgctcgttggttggttaatgccagcgctttatttacgtcttgttttttttgcgtttcctccgcgggtcccttcccaacacgcctgcccccgcctcaggggtagcggataaccggggccatgtcgccggattgcacaacggcggcgccgtcgaacgtacacacccgaaccgccggggccagggccaggatgtccccgagttggcccgcgtgcgccagccaggcgaccagcgcctcgtaaagcggcagcctgcgttcgccgtcctgcatcagcatgggggcttcggggtggatgagctgggcggcttctcgcgtgacgctctgcatctgcaggagcgcgttcacgtatccgtcctgggcgctcagcgcgagcagccgggggatgagcgtgaggatgagggtggttccttcggttatggagtagaccatgttgaggacgagcgaccgcagctcggtgtttacggaggcgagttgctggacgtcggccacgagcgagagacgggccccgttgtaatacagcacgttgaggtcggggagctccccgggcgtccgggggtcggggttgaggtcccggatgccccgggcgaccagccgcgcgactatctcgcgggccaggggcgttgggagcgggaccggaaaccgcagcgtgaggtccagcgactccaggcgcacgtccgtcgcctggccctcgaagacgggcgggacgaggctgacgggatccccgttgcagaggtcgacgggggaggtgttgcggagattgacggtgccggcgtgcgtgagccccaggtccacggggcaggcgacgattcgcgtgggcagcacccgcgtgattaccgcggggaagcgcctgcggtacgccagcaacaaccccaacgtgtcgggactaactcctccggagacgaacgattcgtgcgccacgtccgcgagcgccagctggcggcggatggtcggcagaaagaccactcgaccctcgcaccgctgcagcgccgcggcatcggggcgcgagatacccgaggggatcgcgatgtctgcttcgaaacaatccgtgatcatggcgccgggccgcgagacaccggaacgcgggggtgcgggagggccggaaagcgcaacgcaaccgggacgatgatgaaacagagatggggggcaccgaccgtgtgggagagggggcggggcagggctcagcagcacgcacggggaggtctgtcgtgcgcaggagccccaggtgagaatcagtcccccggagctcgggtctgggttttattgggacctgccctcggaatcgcggctcccagtccaagcccccctggggggggcggggacagggggtgtgtgtgggtaaaagcaacgtcggaaaatcaaacccaatgccccaaacaggaaaaaaaaagacgggcgggtggagggaaagctggggaagaagaagccaattttacagagacaggccctttagcggggaggcgtcgtagatgagatactgcgtaaagtgggtctctcgcgcgtgggcctccccatcgcgggcgctgcgtagcagggcggggtcgctggcgcaggtgatcgggtaggcttcctgaaacaggccgcacgggtcttccacgagctcgcggcaccccggcgggcgcttaaactgcacgtcgctggcagcggtggccgtggataccgccgatcccgtttccacgataagacgctccaggcagcgatgtttggccgtgatgtcggccgcggtgaagaacttgaagcaggggctgaggacgggcgaggccccgttgaggtgataggccccgttgtacagcaggtccccgtacgagaaccgctgcgacgcccacgggttggccgtggccgcgaagggccgcgccgggtcgctctggccgtggtcgtacatgagggctatgacgtccccctccttgtcccccgcgtacacgccgccggccgcgcgtccccgcgggttgcagggccggcgaaagtagttgatgtccgtggccacgggggtggcgatgaactcacacacggcatcctgcccgtggtccatgccggcgcgccgcggcacctgggcgcagccaaagaccgggaggggctgggccggccccagccggtttcccgccacgaccgcgttgcgcaggtacacggcggccgcgttgtctagcagcgggggggccccgcggccgaggtaaaagttttgggggaggttgcccatgtccgtaacggggttgcggacggtggccgtggccgcgacggcggtgtagcccacacccaggtccacgtttccgcgcggctgggtgagcgtgaagttgacccccccgcccgtttcgtggcgggccacctggagctggcccagaaagtacgcctccgacgcgcgctcggaaaacagcacgttctcggtcacgaagcggtcctgccgcacgacggtgaacccgaacccggggtggaggcccgtcttgagctggtgatacagggccacggggctcatcttgaagtaccccgccatgagcgcgtaggtcagcgcgttctcccccgccgcgctctcgcgggcgtgctgcaccacgggctggcggatggaggagaagtagttggcccccagggccggggggaccagggggacgtggcgcgccaggtcgcgcagggccggggggaagttgggcgcgttggccacgtggtcggcgcccgcaaacagcgcgtggacgggcaggacgtagaagtattcgccattttggatggtgtggtccaggtgctggggggccatgagcagcacgccggcgtgcagcgccccgtcgaagatgcgcatgttggccgtcgacgcggtgttggcgcccgcgtcgggcgccgcggagcacagcagcgccgtcgtgcgctcggccatgttgtgcgccagcacctgcagcgtgagcatggcgggcccgtcgacgacgacgcgcccgttgtggaacatggcgttgaccgtgttggccaccagattggcgggatgcagcgggtgggcggggtcggtcacgggatcgctcgggcactcctcaccgggggcgatctccgggaccaccatgttctgcagcgtggcgtacacgcggtcgaagcggacccccgcggtgcagcagcgcccccgcgagaaggccggcaccagcacgtaatagtagattttgtggtggacggtccagtcggccggccggtgcggccggtcgtcggcggcgtcggccgcgcgggcctgggtgttgtgcagcagccggccgtcgttgcggttaaagtcggccgtcgccacgttgcacgccgccgcgtagacgggctcgtgcccccccgcgtcaatccggcagtctcggtggcggtccagggccgcgtgtcgcataaggccgtcgcagtcccacacgaggggcggcagcagcgccgggtcgcgcatcaggtgattcagctcggcctgagcctgcccgcccagctccgggcccggcagggtaaagtcgtccaccagctgggccagggcctcgacgtgggccaccaggtcccgatacacggccatgcactcctcggggaggtcgcccccgaggtaggtcacgatgtacgagaccagcgagtagtcgttcacgaacgccgcgcatcgcgtgttgttccagtagctggtgatgcactgagtcacgagccgcgccagggcgcagaacacgtgctcgctgccgtgaatcgcggcttgcagcaggtaaaacaccgccgggtagctgcggtcctcgaacgccccgcggacggcggctatggtagccggcgccatggcgtggcggccaacgccgagctccaggccccgggcgtcacgaaacgccaccggacacagcgccaggggcaggttgccgttgaccacgcgccaggtggcctggatcgcccccggaccggccggggggacttcgccgccgggaagctcgacgtcggccacgcccgcgaagaagtcgaacgcggggtgcagctccagagccaggttggcgttgtcgggctgcatgaactgctccgcggtcatctggcactcggcgacccaccggacccggccgtgggcgaggcgctgccgccaggcgttcagaaaacgctgctgcatgtccgcgccggggccggccggggccgcgacgtacgccccgtacggattcgcggcctcgacggggtcgtggttcacgcccccgacggccgcgtcgatgttcatgagcgaaggatgacacacggtcccgaccgcgttctccatggacagccgcagaacctggtggtcctttccccaaaaaaacagctgccggggagggaacgcgcggggctccgggtggccgggggcgggcaccaggtccccggcgtgcgcggcgaagcgctccatggccgggttgaacagccccaggggcaggacgaacgtcaggtccatggcgcccaccagggggtagggcacgttggtggcggcgtagatgcgcttctccagggcctccaggaagaccagcctgtcgcctatggccaccagatccgcgcgcacgcgcgttgtctggggggcgctttcgagttcatccagcgtctcccggttcgcctcgagttgctcctcctgcatatccagcaggtggcggcccacgtcgtccaggctccgcacggccttgcccatcaccagcgccgtgacgaggttggccccgttcaagaccatctcgccgtaggtcaccggcacgtcggcctcggtgtcctccaccttcaggaaggactgcaggaggcgctgtttgatggcggcggtggtgaccagcaccccgtcgaccggccgcccgcgcgtgtcggcgtgcgtcaggcggggcacggccacggacggctgcgtcgccgtggtcaggtccacgagccaggcctcgatggcctcgcggcgatggcccgccttgcccaggaagaagctcgtgtcgcaaaagctccgcttcagctcggcgaccagggtcgcccgggcaaccctggtcgccaggcgcccgttgtcgagatatcgttgcatgggcaacagcagggccaggggaggcgccttctccaacagcacgtgcagcatctggtcggccgtgccgcgctcaaacgcccccaggacggcctggacgttgcgcgcgagctgctggatggcgcgcagctggcgatgcaggctaatgcccgtcccgtccagggcctcccccgtgagcagggcaatggcctcggtggccaggctgaaggcggcgttcagggcccggcggtcgatgaccttcgtcatgtaattatgcacgggctgctcgacggggtgcgggccgtcgcgggcgatgaggggctggtggacctcgaactgcacacgcccttcgttcatgtaagccagctccgggaacttggtgcacacgcacgccacggacaggccgagctccagaaagcgcacgagcgacagggtgttgcagtaggaccccagcagggcgtcaaactctacgtcatacaggctgttttcgtcggagcgcacgcgggcgaaaaaatcaaagagtctgcggtgggacgccacctcgatcgtactcaggatggagccggtgggcaccatggccgcggcgtaccggtaacccggggggtcgcgggcaggagcggccattgggttccttgggggattcgcaggctccatcaagccgagctcgggaaggccaagcccctcccgcacaacgcctcaccgccggcggacgcgactaacaacccacgggccgccaaaaccccaaggggcaacccgaccaacaacaggcgaggggaggaaaggcgtaaagggggcgttgggaggcaaaaagaaagaaaacacccagacgtaggcccgaggaccggccggcgtcctctgtccccgagcacccactgtgcccaacaggcacgggggcgagctgcccctgccttatatacccccccgccacacccccgttagaacgcgacgggtgccttcaagatggccctggtccaaaagcgtgctagaaaaaagttggtaaaggcggcaaagcagtccgccgccgccacccacatggcggcgccggccgcgcaggcgattcccagagaacgggcgcggaggggatccgtgcggggcagcagctggctggcggtgatccaatggaaaagcccgtcgggactgaacgtctcatgggcggccgccaccagggcgcacagggccgcgccgcccatgatcacgcacaacccccaaaacacgggtggcgacaacggcaggcgatcccgtttgatgttcacgtacaggaggagcgcccgtgccagccacgtgacatagtaggcgaggacggcggctataatacatgccggcgccaccgcccgtccggtccacccgtaatacatgcccgcggccaccagctccagcggcttgaggaccaggaacgaccaagcaaacatcaccacccgcttggaaaagaccggctgggtgtggggcggaagacgcgagtaggccgaactgacaaaaaaatcagacgtgccgtacgaggacagcgaaaactgttcatcgagcggcagttctccgtcctccccgccacacgcggcctcgtctaccagctcgcgatccaacaaaggaacatcatcccgcattgtcatggtcggtgcggggagccggcgaggcagcaaaaccgaaagtagtgctggcggcgcgggcccgggtccggacccaagcttcagggatggggggcggaggccaaaatcaaacaagcaccgcgcgggttctacacacaacccccacccgggtagtatccgcggatgcgagtgcctggcgaagtcacgtcccagcaggatataaacctcggccgttgggcccggaacccccgaaattcacacccacgccctgacgcccaaatcatgggtggatgtggttcgcgagccgcacatccgtgcgtccgccctcccccgcgggctgatgacgtggcggttagtcagtgggaaggcagggggaaagatgggttgggggaggaaacgaagaaaacacccagagggccacgtcgggaatgcgcccggagttgtccttaaaaggccggccgtgcgtgacggaagccgtcgtttgcccaagcaccgacgccgcgatccacagtggggggagttcctccgtccggccacaaccctacgcgcgggcggcacgcgcgagagcaacccacgggtcccgttcgcgccaccgccagcccttgctcccaccaccctcctcccaccaccccactattcccccccccaagtccgccccgtggctcgccggccatggagctcagctatgccaccaccctgcaccaccgggacgttgtgttttacgtcacggcagacagaaaccgcgcctactttgtgtgcggggggtccgtttattccgtagggcggcctcgggattctcagccgggggaaattgccaagtttggcctggtggtccgggggacaggccccaaagaccgcatggtcgccaactacgtacgaagcgagctccgccagcgcggcctgcgggacgtgcggcccgtgggggaggacgaggtgttcctggacagcgtgtgtctgctaaacccgaacgtgagctccgagcgagacgtgattaataccaacgacgttgaagtgctggacgaatgcctggccgaatactgcacctcgctgcgaaccagcccgggggtgctggtgaccggggtgcgcgtgcgcgcgcgagacagggtcatcgagctatttgagcacccggcgatcgtcaacatttcctcgcgcttcgcgtacaccccctccccctacgtattcgccctggcccaggcgcacctcccccggctcccgagctcgctggagcccctggtgagcggcctgtttgacggcattcccgccccgcgccagcccctggacgcccgcgaccggcgcacggatgtcgtgatcacgggcacccgcgcccccagaccgatggccgggaccggggccgggggcgcgggggccaagcgggccaccgtcagcgagttcgtgcaagtgaagcacatcgaccgtgttgtgtccccgagcgtctcttccgcccccccgccgagcgcccccgacgcgagtctgccgcccccggggctccaggaggccgccccgccgggccccccgctcagggagctgtggtgggtgttctacgccggcgaccgggcgctggaggagccccacgccgagtcgggattgacgcgcgaggaggtccgcgccgtgcatgggttccgggagcaggcgtggaagctgtttgggtcggtgggggctccgcgggcgtttctcggggccgcgctggccctgagcccgacccaaaagctcgccgtctactactatctcatccaccgggagcggcgcatgtcccccttccccgcgctcgtgcggctcgtcggtcggtacatccagcgccacggcctgtacgttcccgcgcccgacgaaccgacgttggccgatgccatgaacgggctgttccgcgacgcgctggcggccgggaccgtggccgagcagctcctcatgttcgacctcctcccgcccaaggacgtgccggtggggagcgacgcgcgggccgacagcgccgccctgctgcgctttgtggactcgcaacgcctgaccccgggggggtccgtctcgcccgagcacgtcatgtacctcggcgcgttcctgggcgtgttgtacgccggccacggacgcctggccgcggccacgcataccgcgcgcctgacgggcgtgacgtccctggtcctgaccgtgggggacgtcgaccggatgtccgcgtttgaccgcgggccggcgggggcggctggccgcacgcgaaccgccgggtacctggacgcgctgcttaccgtttgcctggctcgcgcccagcacggccagtctgtgtgagatatcccaataaagtgcagtcgttttctaacccacggatgccgttgtatgcctatacgggggactatggggggggaaaggaaaggaaacaggaatggagaagggaaaggaacagaggcggtagcggacgcacggcggacacaataacaaacagaccgcggacacggagggagtcggttgggttgggcgtggacgccgctgcgtccacacacccgtttattcgcgtctccacaaaaatgggacgcacgttcggaccaccctaaggatgcccgccagggccgcggtaatcataacgacccccagcgcggacgcggccagaaacccgggggcgatggtggcgatgggcagcgtgtcaaaggccagcagatgaatcacagttccgttggggaacaacaacagggccacggacggcacgtcgctggaaaacacgttcggggtgcccgccaccggcccctgggccagctgctgttgggtggcatccgtgtccaccagcagcaccgacatgacctccccggccggggtgtagcgcagaaacacggcccccacgaggccgaggtcgcgccggttttcggtgcgcaccagccgcttcggctcaatctcccgcgcgtgcccttcgcaggtggcggtgagataggtgataaacagcgggcggcggacgtcaacgcccgtaagcttgtatccgatcccgcggggcaagggggtgtgggtgacgacgtagctggcgttgtgggtgatgggcacgaggatccggggctccgcgttgtgcgacgggccgctacactggtgggtggcctccgggacgaaggcgcggatcagggcgttgtagtgcgcccagcgcgtgagaacggaggccacgccgcgggtctgttgtgccatgacgtccgccgggatgtcggatcgggtggccatggccagcgcgtccaggatgaacccgccctcggcgagatcgaagcgcagggaagctgcgcatggggaaaagtggtccgggagccagaagaggtttttctggtggtcggtcctggctagcgcggcccggagatcggcgtgggtcgccgcggcgacgtcggacgtacacagggccgtggttatgaggaggccccggcgggcgcgttcccgctgctcggccgagggcgcgcccgccaggaacggcgcccggaggacggccgtggcgtaaaacagcgctcggcggaccatcggggcggttagcgcgcggccgccgagaaactcggcgtacagggcgtcgatcaggcgggccgcgctcggggccaccgcgccataggccgcggggctgtccaacacgaacgccagctgatagcccagcgcgtgcgccgccaggctctgctctcgctcgaggatcgcggccaccagatgcccgaggcgcgcctccagccgcaggcgggccgccgggtccaacacggacacgttcaggaacaccgagtcggccgcgcagcccgctgctccccgggcggccaggccggccagcacgcgcgagtgggccaaaaagcccagcaggtcggagaggcgaatcgcgtcgtgggcgtgggccgcgttgacgaacgcaaaccccgacgaggcgagcagccccgcgaggcgccagaacagggacggacgcgcgtccgtgccggagcccgggtcctcccccaaaaactccgcataggcccgcgacatatactgggcgtagttcgtgctctcctcggggtagccggccacccgccggagggcgtccagcgccgagccgttgtcggcgggcgtcggggcccccaggacaaagacgcgatacctggggccggccggaggcccggggagcaccgcgggggcgttttcgtcggtcggatttccgacccgagcgagggtcttgtccgcaggcaccactatgatctcggccggagggctgtcccgcatcgatatcacgagccccatgaagcccttcccgtatcgcgcgcgcacgagcgcggcgtcgcacccgaacgccagcccgcccgtcgtccagacgcccacgggccacgtcgaggccgacggggagaggtacacgtaccgacccggagtccgtagcaggcccctggcggccagccaggtcacggatgcgttgtgcagatgcgcgatgctcaggttcgtcgtcggatgcctcggtgtccccgcgggcggccccgggggcggcgcgttgcgtcggccgtccgggtgcctctcggtcgccccgtcgtctccccgcgggaacgtaagcccctcgcggtccggcgcggccgcgaatgttacccaggcccgggaccgcaacagcgcggaggcgccggggttgtgcgacagtcccttgagctgggtcacctcggcggggggacgggacgtgggccccgcctcggggagctcgggcaggctcgcgttccgaggccggccgagcagataggtctttgggatgtaaagcagctgcccggggtcccgaggaaactcggccgtggtgaccaacacgaaacaaaagcgctcggcgtaccaccgaagcatgggcacggatgccgtagtcaggttgagttcgcccgggggcgccaagcgtccgcgctgggggtcgctggcgtcgggggtgttgggcaaccacagacgcccggtgtttgtgtcgcgccagtacgtgcgggccaaccccagaccgtgcaaaaaccacgggtcgatttgctccgtccagtacgtgtcatggcccccggcaacgcccaccaggacccccatcaccacccacagaccggggcccatggtcgtccgtcccggctgccagtccgcagatgggggggggtgtccgtacccacggcccaaagaggctccgcacctcggaggctatcggaggccctttgttgccgtaagcgcgggccaaaggatggggtggggtgagggtaaaagcacaaagggagtaccagaccgaaaacaaggacggatcggcccgctccgtttttcggtggggtgctgatacggtgccagccctggccccgaacccccgcgcttatggacacaccacacgacaacaatgccttttattctgttcttttattgccgtcatcgccgggaggccttccgttcgggcttccgtgtttgaactaaactccccccacctcgcgggcaaacgtgcgcgccaggtcgcgtatctcggcgatggacccggcggttgtgacgcgggttgggatcatcccggcggtgaggcgcaacagggcgtctcgacacccgacgggcgactgatcgtaatccaggacaaatagatgcatcggaaggaggcggtcggccaagacgtccaagacccaggcaaaaatgtggtacaagtccccgttgggggccagcagctcgggaacgcggaacagggcaaacagcgtgtcctcgatgcggggcagagaccccgcgccgtcctcggggtcggggcgcggggtcgccgcggcgacccccgtcagccggccccagtcctcccgccacctcccgccgcgctgcaggtaccgcaccgtgttggcgagtagatcgtagacacggcgaatggcggacagcatggccaggtcaagccgctcgcccgggcgttggcgtctggccaggcggtcggcgtgttcggcctccggaaggacacccaggaccaggttcgtgccgggcgcggtcgggggcatgagggccacgaacgccaacacggcctggggggtcatgcttcccatgaggtaccgcgcggccgggtagcacagcagggaggcgatagggtgccggtcgaaaacaagggtgagggccgggggcggggcttgcgggcccacagcctcccccccgatatgaggagccaaaacggcgtccgtcgccgcataaggcgtgctcattgttatctgggcgctggtcattaccaccgccgcctccccggccgatatctcgccgcggtccagacggtgctgcgtgttgtagatgttcgtcagggtctcggaggcccccagcacctgccagtaagtcatcggctcggggacgtagacgatattgtcgcgcggccccagggcctccatcagctgcgcggaggtggtggtcttccccaccccgtggggtccgtctatataaacccgcagcagcgtgggcagctccggatccccgcgggctccggaggccccctggcgatggctaggacgggacgccgcgcggccgtcggtaggcccgctcgcacgagcagcctgaccgaacgcaggcgcgtgctgttggccggcgtgagaagccatacccgcttctacaaggcgttcgcccgagaggtgcgggagttcaacgccaccaggatttgtggaacgctgctgacgctgatgagcgggtcgctgcagggtcgctcgctgttcgaggccacgcgcgtcaccttaatatgcgaagtggacctcgggccgcgccgcccagactgcatctgcgtgttcgaattcgccaatgacaaaacgttgggaggtgtgtgcgtcatcctggagctaaagacatgcaaatcgatttcttccggggacacggccagcaaacgcgaacagcggaccacgggcatgaagcagctgcgccactccctgaagctgctgcagtcgctcgcgcctccgggggacaaggtcgtctacctgtgtcctattttggtgtttgtcgcgcagcgtacgctgcgcgtcagccgcgtgacccggctcgtcccgcaaaagatctccggcaacatcaccgcggccgtgcggatgctccaaagcctgtccacgtatgccgtgccgccggaaccgcagacccggcggtcgcggcgccgggtcgccgcgaccgccagaccgcaaaggcccccctccccgacacgtgacccggaaggcacggcgggtcatccggccccaccagagagcgaccccccctccccaggggtcgtaggcgtcgctgcggagggtgggggtgtgcttcagaaaatcgcggcgcttttttgcgtgccggtggccgccaagagcagaccccggaccaaaaccgagtgaggttctgtgtgttgtttttttttttttttcctcgttttgttttctcttctttcccccccccctcccccgcttctggccaagcatcctcacctgcttaagcggaacccgcgggcgcgcggggactcatttgtcgccggcgacacccacccgacaacagcccctgggtgtcgaccgctgtcgcccccgtctgtcgcctctcccttttttccccccctcaaagaacgtggtgttgggcgccggccaattcttcccggagcgccgtcgtcgcccgcccgccgccctcgaacatggacccgtactaccctttcgacgcgctggacgtttgggaacacaggcgcttcatcgtcgccgactccaggagcttcatcacccccgagttcccccgggacttctggatgttgcccgtgttcaacatcccccgggagacggcggcggagcgggcggcagtgctgcaggcccagcgcaccgcggccgcggcggccctggagaacgccgccctccaggccgccgagctgcccgtcgacatcgagcgccggatacgcccgatcgagcagcaggtgcatcacatcgccgacgccctggaggcgctggagaccgcggcggccgcggccgaagaggcggatgccgcgcgggacgccgaggcgaggggggagggcgctgcggacggggcagcgccgtcgcccaccgcgggccccgccgccgcggagatggaggttcagatcgtacgcaacgacccgccgctacgatacgataccaacctccccgtggatctgctacacatggtgtacgcgggccgcggggccgcgggttcgtcgggagtcgtctttggtacctggtaccgcacgatccaggaacgcaccatcgcggacttccccctgaccacccgcagcgccgactttcgagacgggcgcatgtccaagaccttcatgaccgcgctggtcctgtctctgcagtcgtgcggccggctgtacgtgggccagcgccactattccgccttcgagtgcgccgtgctgtgtctgtatctgctgtaccgaaccacccacgagtcctcccccgatcgcgatcgcgctcccgttgcgttcggggacctgctggcccgcctgccgcgctacctggcgcgtctggccgcggtaatcggcgacgagagcggacgcccgcagtaccgctaccgcgacgacaagctgcccaaagcgcagttcgcggcggccggcggccgctacgagcacggggccctggccacccacgtcgtgatcgccacgttggtgcgccacggggtgctaccggcggccccgggcgacgttccccgagacaccagcacccgcgtgaaccccgacgacgtggcccaccgcgacgacgtcaaccgcgccgccgccgcgtttttggcacgcggccacaacctcttcctgtgggaggaccagacgctgctgcgggcgaccgccaacaccattacggccctggccgtgcttcggcggctcctcgcgaacggcaacgtgtacgcggaccgcctcgacaaccgcctgcagctgggcatgctgatcccgggagccgtcccggcggaggccatcgctcggggggcgtccggattggactcgggcgccataaaaagcggcgacaacaacctggaggcgctgtgcgttaactatgtacttccgctgtatcaggcagaccccacggtcgagctgacccagttgtttccggggctggccgccctgtgcctggacgcccaggcggggcggccactggcgtcgacgaggcgcgtggtggatatgtcgtcgggcgcccgccaggcggcgctcgtgcgcctcaccgcgctggagctcatcaaccgcacccgcacaaacaccacccctgtgggggagattattaacgcccacgatgccttggggatacaatacgaacagggcctggggctgctcgcccagcaggcacgcatcggcttggcgtcaaacaccaagcgattcgccacgttcaacgtgggcagcgactacgacctgttgtactttttgtgtctcgggttcattccccagtacctgtccgtggcctagggaagggtgggggtggtggtggtggggtgtttttctgttgttgtttctggtccgcctggtcacaaaaggcacggcgccccgaaacgcgggctttagtcccggcccggacgtcggcggacacgcaacaacggcgggccccgtgggtgggtaagttggttcgggggcatcgctgtattcccttgcccgcttccacccccccccccttcccgttttgtttgtttgtgcgggtgcccatggcgtcggcggaaatgcgcgagcggttggaggcgcctctgcccgaccgggcggtgcccatctacgtggccgggtttttggccctgtacgacagcggggacccgggcgagctggccctggacccagacacggtgcgtgcggccctgcctccggagaaccccctgccgatcaacgtagaccaccgcgctcggtgcgaggtgggccgggtgctcgccgtggtcaacgaccctcgggggccgttttttgtggggctgatcgcgtgcgtgcagctggagcgcgtcctcgagacggccgccagcgccgctatttttgagcgccgcggacccgcgctctcccgggaggagcgtctgctgtacctgatcaccaactacctgccatcggtctcgctgtccacaaaacgccggggggacgaggttccgcccgaccgcaccctgtttgcgcacgtggccctgtgcgccatcgggcggcgccttggaaccatcgtcacctacgacaccagcctagacgcggccatcgctccgtttcgccacctggacccggcgacgcgcgagggggtgcgacgcgaggccgccgaggccgagctcgcgctggccgggcgcacctgggcccccggcgtggaggcgctcacacacacgctgctctccaccgccgtcaacaacatgatgctgcgtgaccgctggagccttgtggccgagcggcggcggcaggccgggatcgccggacacacgtaccttcaggcgagcgaaaaatttaaaatatggggggcggagtctgcccctgcgccggagcgcgggtataaaaccggcgccccgggtgccatggacacatcccccgccgcgagcgttcccgcgccgcaggtcgccgtccgtgcgcgtcaagtcgcgtcgtcgtcttcttcttcttcttttccggcaccggccgatatgaaccccgtttcggcatcgggcgccccggcccctccgccgcccggcgacgggagttatttgtggatccccgcctctcattacaatcagctcgtcaccgggcaatccgcgccccgccacccgccgctgaccgcgtgcggcctgccggccgcggggacggtggcctacggacaccccggcgccggcccgtccccgcactacccgcctcctcccgcccacccgtacccgggtatgctgttcgcgggccccagtcccctggaggcccagatcgccgcgctggtgggggccatcgccgccgaccgccaggcgggtgggcttccggcggccgccggagaccacgggatccgggggtcggcgaagcgccgccgacacgaggtggagcagccggagtacgactgcggccgtgacgagccggaccgggacttcccgtattacccgggcgaggcccgccccgagccgcgcccggtcgactcccggcgcgccgcgcgccaggcttccgggccccacgaaaccatcacggcgctggtgggggcggtgacgtccctgcagcaggaactggcgcacatgcgcgcgcgtacccacgccccctacgggccgtatccgccggtggggccctaccaccacccccacgcagacacggagacccccgcccaaccaccccgctaccccgccaaggccgtctatctgccgccgccgcacatcgcccccccggggcctcctctatccggggcggtccccccaccctcgtatcccccagttgcggttacccccggtcccgctcccccgctacatcagccctcccccgcacacgcccacccccctccgccgccgccgggacccacgcctccccccgccgcgagcttaccccaacccgaggcgcccggcgcggaggccggcgccttagttaacgccagcagcgcggcccacgtgaacgtggacacggcccgggccgccgatctgtttgtgtcacagatgatggggtcccgctaactcgcctccaggatccggacttggggggggtgtgtgttttcatatattttaaataaacaaacaaccggacaaaagtatacccacttcgtgtgcttgtgtttttgtttgagaggggggggtggagtgggggggaaagtgggccgaatgacacaaaaattaggtcggaggggtgaggggggggggctaggagccgaaccgatggcccccacacgcgacggaaggcccggaagactaccacggggagggggtgtggaaagcgaccggtcgcagggagacggggttggtttggggttggtttggggttggttttcccgttagcacatgtctgcatttgtttttctagtcacacgccccccccccccaaataaaaaccaaggcaaaacaataccagaagtcatgtgtatttttgaacatcggtgtctttttatttatacacaagcccagctcccctcccctcccttagagctcgtcttcgtctccggcctcgtcctcgttgtggagcggagagtacctggctttgttgcgcttgcgcagaaccatgttggtgaccttggagctgagcagggcgctcgtgcccttctttctggccttgtgttccgtgcgctccatggccgacaccaaagccatatatcggatcatttctcgggcctcggccaacttggcctcgtcaaacccgcccccctccgcgccttcctccccctccccgcccacgcccccggggtcggaagtcttgagttccttggtggtgagcggatacagggccttcatgggattgcgttgcagttgcaggacgtagcggaaggcgaagaaggccgcgaccaggccggccaggaccagcagccccacggcaagcgccccgaaggggttggacataaaggaggacacgcccgagacggccgacaccacgccccccactactcccatgactaccttgccgaccgcgcgccccaagtcccccatcccctcgaagaacgcgcacagccccgcgaacatggcggcgttggcgtcggcgcggatgaccgtgtcgatgtcggcaaagcgcaggtcgtgcagctggttgcggcgctggacctccgtgtagtccagcaggccgctgtccttgatctcgtggcgcgtgtagacctccaggggcacaaactcgtggtcctccagcatggtgatgttcaggtcgatgaaggtgctgacggtggtgacgtcggcgcgactcagctggtgagagtacgcgtactcctcgaagtacacgtagcccccgccgaagatgaagtagcgccggtggcccacggtgcacggctcgagcgcgtcgcgggtgaggcgcagctcgttgttctcgcccagctgcccctcgatcagcgggccctggtcttcgtaccgaaagctgaccagggggcggctgtagcacgtccccggccgcgagctgacgcgcatcgagttctgcacgatcacgttgtccggggcgacgggcacgcacgtggagacggccatgacgtctccgagcatgcgcgcgctcacccgccggccgacggtggcggaggcgatggcgttggggttgagcttgcgggcctcgttccagagagtcagctcgtggttctgcagctcgcaccacgcgacggcgatgcgccccagcatgtcgttcacgtggcgctgtatgtggttatacgtaaactgcagccgggcgaactcgatcgaggaggtggtcttgatgcgctccacggacgcgttggcgctgggcgcctcccgcagtggcgcgggcgtggcattccggggcttgcggtcctgctcccgcatgtactcccgcacgtacagctcggcgagcgtgttgctgaggaggggctggtacgcgatgaggaagccccccgtggccaggtagtactgcggctggcccaccttgatgtgcgtggcgttgtacttgcgcgcaaacatgcggtcgatggcctcgcgggcatcccggccgatgcagtcgcccaggtcgacgcgcgagagcgagtactcggtcaggttggtggtgaaggtggtcgagatggcgtcggaggagaagcggaaggagccgccgtactcggcgcggagcatctcgtccacctcctgccacttggtcatggtgcagaccgccggtcgcttcggcacccagtcccaggccacggtaaacttgggggtcgtcagcaagttgcgggtcgtcggcgacgtggcccgggccttcgtggtgaggtcgcgcgcgtagaagccgtcgacctgcttgaagcggtcggcggcgtagctggtgtgctcggtgtgcgacccctcccggtagccgtaaaacggggacatgtacacaaagtcgcccgtcgccagcacaaactcatcgtacgggtacaccgaccgcgcgtccacctcctcgacgatgcagttgaccgtcgtgccgtaccgatggaacgcctccacccgcgaggggttgtacttgaggtcggtggtgtgccacccccggctcgtgcgcgtggcgaccttcgccggcttgagctccatgtcggtctcgtggtcgtcccggtgaaacgcggtggtctccatgttgttccgcacgtacttggccgtggagcggcagacccccttggcgttaatcttgtcgatcacctcctcgaagggaacgggggcgcggtcctcgaatatccccataaactgggagtagcggtggccgaaccacacctgcgacacggtcacgtctttgtagtacatggtggccttgaatttgtacggggcgatgttctccttgaagaccaccgcgatgccctccgtgtagttctgcccctccgggcgcgtcgggcagcggcgcggctgctcaaactgcaccaccgtggcgcccgtcgggggcgggcacacgtaaaactgggcatcggcgttctcgaccttgatttcccgcaggtgcgcgcgcagcgtggcgtggccggcggcgacggtcgcgttggcgtcggggggcggggtcgcctcgggccgcttgggcggctttttggttttccgcttccgggccttggtggtcgcggggctcgggacggggggcggccgggaggcgggacccccgttcgccgcgacggtcgcggccacgccgcccgaggcgcggggggccgccggggccgccggggccgccgacgccaccgcggccaccagcgcccccacgaccagcgcgcaaatcaagccccccccgcgcatggcgggcctacgggggcgcgtcgctcccgccgcccgctagtctgggggcgaggtgctgcaggaccgagtagaggatggaaaaaacgtctcggtcgtaaaccacgaccgagcggggtccgatgcagccgtcggggccgctctcgacgatggccaccagcggacagtcggagttgtacgtgaggtacacgcccggcgggtagcggtacagaccttcggaggtcgggcggctgcagtcggggcggcgcaactcaagctccccgcaccggtagaccgacgcaaagagtgtggtggcgataatgagctcgcgaatatatcgccaggcggcgcgctgggtgggcgtgattccggaaacaccgtcaaaacagtagaacttttgaaactcgctgacggcccaatcagcgcccgaaccccccgcgcccatgatgaagcgggcgagttcctccttgaggtgcggcaggagccccacgttctcgacgctgtagtacagcgcggtgttggggggctgggcgaagctgtgggtggagtggtcgaacaggggcccgttgacgagctcgaagaagcgatgggtgatgctggggagcagggccgggtccacctggtggcgcagcagcgacgctcgcatgaaccggtgcgcgtcaaacacgcccggggcggcgcggttgtcgatgaccgtgcccgcgcccgccgtcagggcgcagaagcgcgcgcgcgccgcgaagccgttggcgaccgcggcgaaggtcgcgggcagcacctcgccgtggacgctgacccgcagcatcttctcgagctccccgcgctgctcgcgcacgcagcgcccgaggctggccagcgaccgcttggtcaggcggtccgcgtacagccgccggcgctcccgcacgtccgcggcggcccgcgtcgcgatgtcgccccagctctccggcccctgcgcccctggctcggggccgcgctccccgtcctcgctcgcgggcgtccccgcgccacgcctccgccccccctcctccgcggcggcccggggctcttcctcctcggcccccccggtcgcgccgccggcccccagccgcgccagcacgcggcgcagcgcctcctcgtcgcactgctcggggctgacgagccgccgcagcagcggcgtcgtcaggtggtggtcgtagcacgcgcgtatcagcgcctcgatctgatcgtcgggcgacgtcgcctggccgccgatgatcagggcgtccaccatgtccagcgccgccaggtggcccccgaacgcgcgatcgaagtgctccgcccgccgcccgaacagcgccagctccacggccaccgcggcggtctcctgctgcagctcgcgctgcgccagcgcgttcaggttgtcggcgaaggcgtccatggtggagtggcgggcgcgatcgccggacgccagccagaagcgcagctcgctgatggcgtacaggccgggcgtagtggcctgaaacacgtcatgcgcctccagcagggcgtcggcctcctcgcggacagaagagctatcggcgggcggcgggccggcccgggccccgccgcccgccgcggtccgcgccagcgcctggtccagcacacagagcgctcgcgcgcgggcggcgtccgacagcccggcggcgtggggcaggtaccgtcgcagctcgttggcgtccagccgcacctgggcctgttgggtgacgtggttacagatgcggtccgccaggcggcgggcgatggtcgccccctggttcgcggtgacgcacagctcctcgaaacagaccgcgcacgggtgggacgggtcgctcagctccgggggcacgatgaggcccgaccccaccgccgccaccataaactcccggacgcgctccagcgcggccgtggcgccgctcgggggggtgatgaggtggcagtagttcagctgcttgagaaaattctcgacatcatgcaggaagcacagctccatgcggacgtccccgccgtacgtctgcagccggatctgctggtggtacggacagggtcgggccagacccatggtctcggtgaaaaaggcagagacgtcacccgtggtcgcgaacgtttccaggtggcccaggagccgctccccctcgcgccacgcgtactccaggagcaactccagggtgaccgacagcggggtgagaaaggcggcggcctgagcctccagccccggccgcaggtgccgccgcagcacgcgcacctggagcgcgttgagctttagctgggcgagcttccccaggccgatctgggggtcgcatcgtcgaagcagctctagctgaaaaacgtacgtctgtacctgcccgagcagggccaacagtttctgtcgggccgcagtgggctcggaaaccgcggccgggggcgcggccgccatggcgagtcacccggccgtgctgtggtttagttaaggtttgggggggggtgggtcagaggcgcgccccgcgcggactgatgcggcggcgggcccctgacatcccctctttatgcccgtcgcccgcccgcccgccccgccggtgtgccgtgattcgcggagtcggggccttgtgtttctttctttcccccccgaatccgttctttcttcctcacccccccctccccacacacccacccaggactcgccaccacaaggaggcgagagcccgtcgctaacccaaagacacagtcacgagacacgatatcgactgtagttgcgatcgtttattttatacacaacaccaacctttccttcgaccccccccacccccgcccctagagcatatccaacgtcaggtcctttttctccggtggtccctccccaaacggatcgtcgccgtgaaacgcccgctttcgggcgacgccggccgcccccgccgccgccgccaaaccgccgaacgacgccgcgtggtcatcctcgtcgccgaaatccccaaagttaaacacctccccggcggcgccgagctggctgaccagggcctccgcctcgtgggccacctccagggccgcgtcggtcgaccactcgccgtgcccgcgctccagggcgcgggtggtaaactccatcatttcctcgctcaggtactcgtcctccagcagcgccagccagtcctcgatctgcagctgctgggtgcgggggcccaggctcttgacggtcgccacaaacacgctgctggcgaccgccgccccgccctccgcaatgatgccccggagctgctcgcacagcgaatgctcgtgggccccgcccccgagactcgacgccgcgcacacaaacccggccctggggcaggccaggacaaacttgcgggtgcggtcaaagatcagcagcgggcacgcgtttttgccgcccagcaggctggcccagttcccggcctgaaacacgcggtcgttgccggccatgccgtagtatttgctgatgctgaggcccagcacgaccatcgggcgcgcggccatcacgggccgcagcaggttgcagctcgcgaacatggacgtccaggcgccggggtgcgcgtcgagggagtccatcagcgcgcgggccccggcctccaggcccgcgccgccctgcggggcccaggcggccgccgcctgcacgctggggggacggcgggacccggcgatgacggccgtgagggtgtttatgaagtacgtcgagtggtcgcagtacctcaagatctggttggccatgtagtacatggccagttcgctcacgttattgggggccaggttgataaagttaatcgcgccgtagtccagggagaacctcttaatgaacgcgatggtctctatgtcctcgcgcgacaagagccgggcggggagctggttgcgctggagggcggtccagaaccactgcgggttcggctggttcgaccccgggggcttgccgttgggaaagatgaccgcgtggaactgcttcagcaggaagcccagcggtccgaggaggatgtccacgcgcttgtcgggcttctggtaggcgctctggaggctggcgacccgcgccttggcggcctcggacgcgttggcgctcgcgcccgcgaacaacacgcggctcttgacgcgcagttccttgggaaacccaagggtcacgcgggcaacgtcgccctcgaagctgctctcggcgggggccgtctggccggccgttaggctgggggcgcagatagccgccccctccgagagcgcgaccgtcagcgtcttcgccgacaggaacccgttgttgaacaggtccatgacgcgccgccgcagcaccggttggaattgattgcgaaagttgcgcccctcgaccgactgcccggcgaacaccccgtggcactggctcagggccaggtcctggtacacggcgaggttggaccgccgcgcgaggagctgcagcagggggcacggcccgcaggtgtacgggtccagcgacagcgacatggcgtggttggcctcggccagaccgtcgcggaacttaaagttgcgcccctcgatcaggttgcgcatcagctgttccacctcgcgatccaccagctgcttgatgttgttcaccaccgtgtgcagggcctcgcggttgccgataatcgtctccagcctccccagggccgtgggcaccgcctggtccacgtactgcagggcctcgagctcggccatgacgcgctcggtggccgcgcggtacgtctcctgcatgatggtccgggtgttctcggacccgtccgcgcgcttcagggccgagaaggcggcgtagttccccagcacgtcgcagtcgctgtacgcgctgttcatcgttccgaagaccccaatggccccccgggcggcgctcgcgaacttggggtggcgggcccgcagccgcatcagcgtcgtgtgcgcgcaggcgtggcgggtctcgaaggtacacaggttgcagggcacgtcggtctggcccgagtccgcgacgtagcgaaacacgtccatctcctggcgcccgacgatgactccgccgtcgcagcgctccaggtaaaacagcatcttggccagcagggccggagagaacccgcacagcatggccaggtgctcgccggcgaactcctgggttccgccgacgaggggcgccgtggggcgcccctcgtacccgggcaccacgtggccctcgcggtccagctgcgggttggccgccacgtgcgtgccgggcacgagaaagaagcggtaaaaggagggcttgctgtggtccttggggtccgccggcccggcgtcgtccacctcggtcaggtggagggccgaattggtgctgaacaccatggcgcccacgaggcccgcggcgcgcgccaggtacgccccgacggcgccggcgcgggccgcgggcgtttcctggccctcaagcaggggccacgtggtgatgtcggggggcggctcgtcaaagaccgccatcgacacgatggactccagggccagggcggcgtcgcccgccatcaccgaggccaggcgctgctcaaacccgcccgccgggcccttgttcccggcgtcgcgcgcgccccgctggggcttaccctggctggcctcgaaggccgtgaacgtaatgtcggcggggagggccgcgccctcgtggttttcgtcgaacgccaggtgggcggccgcgcgggccacggcgtccacgttccgggcacgcagggccacggcggcgggcccgacgaccgcctcgaacagcaggcgggcgagggggcggttgaaaaacggaagggggtagttgaaattctccccgatcgatcggtggttgcagttaaacggatcggcgatgacccggctaaaatccggcataaacatctgcagcggatacacggggatgcggtgaacctccgcgtccccgatggttaccttgtccatcccgcccagatgcaggaaggtgttgctgatgcacacggcctcccggaagccctccgtgatcaccagatacagcaaggcccggtccgggtccagtccgagccgctcgcacagcgcgtcccccgtcgtctcgtgctttaggtcgcagggccggggcgcgtagtccgcgaagccaaaatggcggcgcgcccgctcgcagagccgcgtcaggttgggggcctgggtgctgggggccaggtggcggccgccgtgaaagacgtaaacggacgggctgtagtgcgagggcataagcttgagggacaccgcggtccccccaaggcccgtcgtgcgggacccgacgaccgcggccacgttggcctcaaacccgctctccacggtcaggccgacgatgaggggcgcgacggcgacgtccgcgtcgccgctgcgcgccgacagtagcgacagcagctccaggccttcggccggacaggcgcggccatacacgtaccccatcggccccggaggaaccttgacggtggtcgtcgttttgggcttggtgtccatggctttcgggagatcggcgaccggcaggaacgggggcccggcaagacgaccgggggcagacgggggaggccgcgcgtggtcgacggctgctgcccgccgtcgtctctccgatggggtcgaatgccggcgctgggggtggggtctacacccgcccgttcgccgagcggcccctggtgggggtgggatgggtgggatggggtgggcgagaatggcccgccaccggatcgcgccggacgggggggcccggggttgggcaaggtttgggcgcaaggctccagcggcgattcgagaggcctgcggatggcggcccagagctgggtatgctcggccggggcggccggtatatgtacggcgtgctgggaggggcggcgtcgggccccgcccacggtccgccacgccccgcgcgtcatcggcagggggcgtggccgcccttctaaaaaaagtgagaacgcgaagcgttcgcactttgtcctaataatatatatactattaggacaaagtgcgaacgcttcgcgttctcactttttttagaagggcggccacgccccctttgacgtcacgctcacccgggcggccggccgcccataagcgcggcctgccgggccgataaaaagaaaccgcggcgcccccgcggacaccacacactggctctcgaaccccggacgcgcagaagggacccgggcgcgggtccgccggtaagagccggggggaacatcggcaccgccatcccaccccgagctgttgggtgggcgggtgggggggctggtgaggcggtggtgggagggggcggcgtatagcaggacaacgaccggcggcgatgttttgtgccgcgggcggcccggcttcccccggggggaagccggcggctcgggcggcgtctgggttttttgccccccacaacccccggggagccacccagacggcaccgccgccttgccgccggcagaacttctacaacccccacctcgctcagaccggaacgcagccaaaggccctcgggccggctcagcgccatacgtactacagcgagtgcgacgaatttcgatttatcgccccgcgttcgctggacgaggacgcccccgcggagcagcgcaccggggtccacgacggccgcctccggcgcgcccctaaggtgtactgcgggggggacgagcgcgacgtcctccgcgtgggcccggagggcttctggccgcgtcgcttgcgcctgtggggcggtgcggaccatgcccccgaggggttcgaccccaccgtcaccgtcttccacgtgtacgacatcctggagcacgtggaacacgcgtacagcatgcgcgccgcccagctccacgagcgatttatggacgccatcacgcccgccgggaccgtcatcacgcttctgggtctgacccccgaaggccatcgcgtcgccgttcacgtctacggcacgcggcagtacttttacatgaacaaggcggaggtggatcggcacctgcagtgccgtgccccgcgcgatctctgcgagcgcctggcggcggccctgcgcgagtcgccgggggcgtcgttccgcggcatctccgcggaccacttcgaggcggaggtggtggagcgcgccgacgtgtactattacgaaacgcgcccgaccctgtactaccgcgtcttcgtgcgaagcgggcgcgcgctggcctacctgtgcgacaacttttgccccgcgatcaggaagtacgaggggggcgtcgacgccaccacccggtttatcctggacaacccggggtttgtcaccttcggctggtaccgcctcaagcccggccgcgggaacgcgccggcccaaccgcgccccccgacggcgttcggaacctcgagcgacgtcgagtttaactgcacggcggacaacctggccgtcgagggggccatgtgtgacctgccggcctacaagctcatgtgcttcgatatcgaatgcaaggccgggggggaggacgagctggcctttccggtcgcggaacgcccggaagacctcgtcatccagatctcctgtctgctctacgacctgtccaccaccgccctcgagcacatcctcctgttttcgctcggatcctgcgacctccccgagtcccacctcagcgatctcgcctccaggggcctgccggcccccgtcgtcctggagtttgacagcgaattcgagatgctgctggccttcatgaccttcgtcaagcagtacggccccgagttcgtgaccgggtacaacatcatcaacttcgactggcccttcgtcctgaccaagctgacggagatctacaaggtcccgctcgacgggtacgggcgcatgaacggccggggtgtgttccgcgtgtgggacatcggccagagccactttcagaagcgcagcaagatcaaggtgaacgggatggtgaacatcgacatgtacggcatcatcaccgacaaggtcaaactctccagctacaagctgaacgccgtcgccgaggccgtcttgaaggacaagaagaaggatctgagctaccgcgacatccccgcctactacgcctccgggcccgcgcagcgcggggtgatcggcgagtattgtgtgcaggactcgctgctggtcgggcagctgttcttcaagtttctgccgcacctggagctttccgccgtcgcgcgcctggcgggcatcaacatcacccgcaccatctacgacggccagcagatccgcgtcttcacgtgcctcctgcgccttgcgggccagaagggcttcatcctgccggacacccaggggcggtttcggggcctcgacaaggaggcgcccaagcgcccggccgtgcctcggggggaaggggagcggccgggggacgggaacggggacgaggataaggacgacgacgaggacggggacgaggacggggacgagcgcgaggaggtcgcgcgcgagaccgggggccggcacgttgggtaccagggggcccgggtcctcgaccccacctccgggtttcacgtcgaccccgtggtggtgtttgactttgccagcctgtaccccagcatcatccaggcccacaacctgtgcttcagtacgctctccctgcggcccgaggccgtcgcgcacctggaggcggaccgggactacctggagatcgaggtggggggccgacggctgttcttcgtgaaggcccacgtacgcgagagcctgctgagcatcctgctgcgcgactggctggccatgcgaaagcagatccgctcgcggatcccccagagcacccccgaggaggccgtcctcctcgacaagcaacaggccgccatcaaggtggtgtgcaactcggtgtacgggttcaccggggtgcagcacggtcttctgccctgcctgcacgtggccgccaccgtgacgaccatcggccgcgagatgctcctcgcgacgcgcgcgtacgtgcacgcgcgctgggcggagttcgatcagctgctggccgactttccggaggcggccggcatgcgcgcccccggtccgtactccatgcgcatcatctacggggacacggactccattttcgttttgtgccgcggcctcacggccgcgggcctggtggccatgggcgacaagatggcgagccacatctcgcgcgcgctgttcctccccccgatcaagctcgagtgcgaaaaaacgttcaccaagctgctgctcatcgccaagaaaaagtacatcggcgtcatctgcgggggcaagatgctcatcaagggcgtggatctggtgcgcaaaaacaactgcgcgtttatcaaccgcacctccagggccctggtcgacctgctgttttacgacgataccgtatccggagcggccgccgcgttagccgagcgccccgcagaggagtggctggcgcgacccctgcccgagggactgcaggcgttcggggccgtcctcgtagacgcccatcggcgcatcaccgacccggagagggacatccaggactttgtcctcaccgccgaactgagcagacacccgcgcgcgtacaccaacaagcgcctggcccacctgacggtgtattacaagctcatggcccgccgcgcgcaggtcccgtccatcaaggaccggatcccgtacgtgatcgtggcccagacccgcgaggtagaggagacggtcgcgcggctggccgccctccgcgagctagacgccgccgccccaggggacgagcccgcccccccagcggccctgccctccccggccaagcgcccccgggagacgccgtcgcatgccgaccccccgggaggcgcgtccaagccccgcaagctgctggtgtccgagctggcggaggatcccgggtacgccatcgcccggggcgttccgctcaacacggactattacttctcgcacctgctgggggcggcctgcgtgacgttcaaggccctgtttggaaataacgccaagatcaccgagagtctgttaaagaggtttattcccgagacgtggcaccccccggacgacgtggccgcgcggctcagggccgcggggttcgggccggcgggggccggcgctacggcggaggaaactcgtcgaatgttgcatagagcctttgatactctagcatgagccccccgtcgaagctgatgtcccgcatcttgcaataaatgtctgcggccgacacggtcggaatttccgcgtccgctggtttctctgcgttgcgtctgaccacgagcacaaacgtgctctgccacacgtgggcggcgaaccggtagccggggcacgcggtcagcatccgatcgatgagccggtagtgcaggtgggccgacgtgccggggaagatgacgtacagcatgtggcccccgtacgtggggtccgggtaaaaaagaaaccgggggtcgcacgccccccctccgcgcaggatcgtgtgcacgaaaaagagctcgggctggccgagcgtatcggccaggaggtcctggaggggggtgctgtggcggtcggccagcacgaccagggaggccagaaaggtgcggtgctcaaagatcgtattgatctgctgcacgaaggccaggatgagggcctcgcggctgacggtggccagccgcccgtcgcccgcgctgcacgcggggcagcagcccccgatccccaggtagtagcccatgcccgagagggtcaggcagttgtcggccacggtctggtccaggctgaaggggagcgacacgggggtcgtcttcaccaggggcacggagagcgagcgcacgatggcgatctcctcggagggcgtctgggcgagggcggcgaagaagccgcggtagcgacggcgctcgtgcaggcagagctccagcctgcgcgcgtgcgacggcaggctcttgcgggaggcccggcgctccacgccggggttcccggcggcggaaaagcgcgaccgccgccgggtcttgtcgcggccgggcccgggccgggagccggagcgacggggggcgatgtcatacataggtacagagggtgtgctccagggacaggagagagatcgagtgtcgtctgagcagcgcgccggcctcgcggacaaatgtggccagcgcggtgggcttcggcacaaatacctggtacgtcttgaaggtgtagatgagggcccgcagggctatacagacccgcccctcgaactcgttgccgcaggccaacttggccttgtgaagctgcagctcgtcgcgatggtcggcgcgggggtggccaaacaggacccaggggtcgacttccatctccgtgatggcgcacatcggatcgcagaacatgtgcttgaagatggcctcggggcccgcggcccgaagcaggctcacgaaccggcccccgtccccgggctgcgcctcggggtccgcctcgagctggtccacgaccggcactatgcagtcgaagaggctggtgttgttctccgagtagcggacgacggacgccctcaggcgtcgcatggccagccagtaggcccgcaccagcaacagattgcacagcaggcattccccgccggtgcgcccgcggccccggccgtgcttcagcacggtggccatcagcgggcccaggtccaggtcgggctgggcctggggctcggcgaactgcgcaaaacgcggggccgcgtcgcgcatgcgcgccccgcggtgcgcttcccaggactcgctgaccgcggcgcggcgggcgtccgcggcggcgcgcagccggggccccgactcccagacggcgggggtgccggcgagcagcagcaggatcaggtcggcgtacgcccacgtctccggctcacccccctgcgccagcgccccggcggcggcctcgaactccccgttgcgggcggcggcgcgcgtgcagcagctgtctccgcccccgcgcttgccctcggtgcagtcgagcaggcgggcgcagtccttccagttcatcagggcggtggtgagggagggttgcgttcccgagcccccgcccgcccccgcccccgccccgtcatcgcccccggaggccagggtcccgatgagggcccgggttgcggactgcgcgaggaaggaatagttggagtactgcaccttggcggcgcccggggagggcgtcggcctgggttgcttctgggcgtggcgcccgggcaccccgccgtcggtccggaagcagcagtggagaaagaaatgccggtggatgtcgttgatggtcagggcgaagcgcgcgaaggagccgacaagggtcgccttcttggtgcgcaggaagtggtggtccatgacgtagacgaactcgaaggcggccacgaagatgctcgcggcgcagtggggcgcgcccaggcacttggcgcagaggaacgcgtaatcggccacccactggggcgagaggcggtaggcctgcttgtacagctcgatggtgcggcagaccagacaggggcggtccagcgcgaaggtgtcgacggacgccgcggcgaagggccccgtgtccaagagtccctctgccgtggggtctgcgggcgggccgcgggcggaccccggcccccgcccccccgaagcctcgcgcgcggccccgcgcggccgcgggggggcgggcgcgacgtcgctctccacgtcctcgtcgagcgcgctcgcgggcggcacgcctaccacgtgacaggccgccaggagctcggcgcacagggcctcgttaagagccagaaggtcgggatcgaaggccacatacggacgctcgaacgcgccctccttccagctgctgcccggcgactcttcgcgcacggcggcgctcgacggcacccccggggcggacgtcgccatggccggtcgagcggggcgcacgcgtccgcgaacgttacgggacgcgatccccgactgcgcgctgcggtcccagaccctggaaagtctagacgcgcgctacgtctcgcgagacggcgcgggggacgcggccgtctggttcgaggacatgacccccgccgaactagaggttatattcccgaccacggacgccaagctgaactacctctcgcggacgcagcggctggcctccctcctgacgtacgccgggcctataaaagcgcccgacggccccgccgccccacatacgcaggacaccgcgtgcgtgcacggcgagctgctcgcccgaaagcgcgaacggttcgcggcggtcattaaccggttcctggacctgcaccagatcctgcggggctgacgcgcgcttcggcggggcaccggcaccgggaccgacttgttttacataacagtagggggtgggggaacgcgcacccttgcccggtcgcgatggcggggatggggaagccctacggcggccgcccgggggacgcgttcgagggtctcgttcagcgcatcaggctcattgttcccgccacgctgcgcggcgggggtggggagtcgggcccctactcgccatccaacccgccctcgagatgtgccttccagttccacggccaggatgggtccgacgaggccttcccgatcgagtacgtcctgcggctcatgaacgactgggccgatgtgccctgcaacccctacctgcgcgtgcagaacaccggcgtttcggtgctgtttcaggggttttttaaccggccccacggcgccccggggggcgcgatcacggcggagcagaccaacgtgattctgcactccaccgagacgacgggactgtccctcggagacctggacgacgtcaaggggcgcctcggcctggacgcccggccgatgatggccagcatgtggatcagctgctttgtgcgcatgccccgggtgcagctcgcgtttcggttcatgggccccgaggacgccgttcgcacgcggcggatcctgtgtcgcgccgccgagcaggccctcgcccgtcgccgccggtccaggcggtcccaggatgactacggggcggtggtggtggcggcggcgcaccactcttccggagcgcccgggccgggggtcgccgcctcgggcccgccagcgccgcccggacggggaccggcccgtccgtggcatcaggccgtgcagttgttccgggccccgcgtccgggccccccggcgcttctgttgctggcggcggggctgtttctgggggccgctatctggtgggcggttggcgcgcgcctatgaaagggggcgagccaccgtcccgcccgccagtgcatcccagacgcccgcgagccgcacatcccctccgctcccgcctccggcccgattcttacggcgcgacccaaggtcccgatggccgccccgcagtttcaccgccccagcaccattaccgccgacaacgtccgggcgctcggcatgcgcgggctcgtgttggccaccaacaacgctcagttcatcatggataacagctacccgcatccgcacggaacgcagggtgcggtgcgagagtttcttcgcgggcaggccgcggcgctgacggacctcggggtgacccacgccaacaacacgttcgccccgcagcctatgttcgcgggcgacgccgcggccgaatggctgcggccctcgttcggtcttaagcgcacgtattccccctttgtcgttcgcgaccccaagacccccagcaccccgtgagtcctcggcgggtccctccgcggccgtctctcgttgcccccctttcccccttcccgggtggttcaataaaaaacaccaacatacgatattcgcgtttgatacgtttattggggggggtgtagggcccaacgatcggcgattaacaacaccaaacaatcgagcgcgtctaacccagtaacatgcgcacgtgatgtaggctggtcagcacggcgttgctgcgctgaaacagcgccctgcgggtccgctgcagctgttgttgtatgcggcggcatgcgcggatcaaaaccgccagggcgctacgaccggtgcttcgtacgtagcgtcgcgacaagacggcatttgcctgtacgggcaaggggccaaattgcgagtgtggtgactggaggtggtcggcggccaatgggccgggtggttcgtcggcggggggcaagtgcggttccggtgggagggggtcgagcgcctcggtatcatccgagtccgagaaacgcagggagtctgcgtcggagtgttcatcatcggaggagatgtgcagcgtctgaagcagcgatgcgggtgggggcgcggagtcgacgtgaagcgcgagagaggaagcccacgaagtcacagcggacactgggaggtgggtgtttgtatgtgtgggagactcgggcgtcgggaccgagtctcggctctggggtgtaagcgtccgagttacgggcggcaggggcggctggggcaggggcggctggggcaggggcggctggggcaggggcggctggggcaggggcggctggggcaggggcggctggggcaggggcggctggggcaggggcggctggggcaggggcggctggggcaggggcggctggggcaggggcggctggggcaccgagcgcgcgcggatgcgcgtccgcgcggcgggtttggtcgcgggtgactggggtggggggcggcgggcaaccgggcctccgggcacgacccaaccgcacaaaggctcgctcggggcaaccgggcctggggccaaaggcggggggctggtctggacggcggaggtcgggggggcaaggcccggagaaggcggcactgccgccgctgcggcggaaaccgcggccgcgtggtcggctgggtcccggggagaggggagggagttcaacgaggccgagagcgaggcgaccgcggggcgcgtgaggcgccggggtgggccggccgcggggccccgggggggtgtcggcgagggacccgctgttgtctggcggcggccgcggcggcggtcgcccccggggacgaccgctccttcggcgggcggaggcgggatgggcgcgagcgtgggggcgggaaaggccccgcgagccgaggcggggccgggcggaaggggcaaagcagaaacccaagccgggggcgcggactccggggtgggcggctggtcgggaggacgcgcggaagcggcgaccggggcgaccggggcggggagtgccggcggacgccacccctcggggggggcggaggcccggggcgcgcgcgatttggcacgcgtccggcgggacctgcgcacgcgcggcacggcggcggagaaagcggcggcagagccggaaaaggccgggggaggaagcgcggcatccgcggggggactcggtgtgggtggcgagggccgtgggtcgtcgcgaggggccacgggcacgcgccccgtgttttgttgaggcgggacactcggtcgtgtttcgcgagccgtagctgccggcccgatgggccgcggtgcgtactgggacgtggggacggactgatcggtggcgggggggggaagaagggccggggccggattgggcgtggggccgccggcgtcgtcggacgccagctcctccaggccgtggatccaggcccacatgcgaggggggacgggctcgccggtggtggcgtcggtgaggagagtgggggcgaggacccccgggtccgcctgccgtgcggggggggcagcggggtcctcgggacccgatccgccatccccccccgcaaggtcccgcgggtcgcgggcggcggtcggggcagagggacctgcctcgtcggcgagggggcgctggtaaaccgggtgtcccgggaacagctcccccgtcaggagggaggcgtcgaagggccgcccgaggatggcccgcgcgaagaaggggtccgcgtcggcggcgctcgccgcgagaacgtcccccgcggtagccacaaacggaagctcctcggtggcctcgctgcccacaaaccgcacgtcaggggggccggggggctccggggcttcccacaagaccgcgaccggggtcatggagatgtccacgaggaccaggcacgggggcccgtcggcgagagggcgctcggcgatgagcgccgacaggcgcgggagctgcgccgccagacacgcgttttcgatcgggttgagatcggtgtggaggaggccgacggcccacgtctcgatgtcggacgacacgacgtcgcgcagggcggcgtccggcccgccggggcgcgagtcgaagagcgtcaggcacagttccagttccgactcgcgggagaaggccgtggtgttgcggagcgccaccacgacgggcgcgccgaggagcaccgcggccagaaccaggtccatggccgtaacgcgcgcggcgggggtgcggtgggtcgcggcggccagcacggccacgtgctggcccgtgggtcggtagagggcgtggggggcctcggggagggacgccttgcgcccccccgccgggccgagcgtctggccagactccaggcgtgcggccaggagggcgtcgaagctgtcgtactcggtgtagtcgtcgggaaacatgcaggtccacagcgcggccaaagcggcgctcggcagacacatgcgcccgaggacgctcaccgccgccagggcctgggccggactgagcttcccgagcgccgggacgtcccggcgctgggtcccgagctccaaggccgagcgccagggcgccagcgggtcggtttcggacagcttgccccggcgccagtcggccagccgcgtgccgaacaggaggccccgggtcggggggcctccgtccaaaaacgtcggcaacacgcggatgcgggcgtcgggatgcggggtcaggcgctggacgaacagcatggactccgctgcgtcctcgaacgcgcgttcgagggtgaggtgcatgtactcgtgctggcgaacgaggtccaggcgccagaagttgtagatgtgttccggaacgccggccaccagcgcgaccagcacgtcgttctcgttgaaggcgacgcagtggcgctgggacccccgggggcccggcggcggacgcggcgccgccgctccggacgcccagcccagctgggcccagcgacacccaaactcgcgcgtgagggtggtggcgacgagggcgacgtacagctcggccgccgcgtccatcgaggcgccccacgtcgcctggcgatggcgcacgaagcgaccgaacagctgaaagttggcggcctgggcgtcgctgagggccagctggagccggttcacgacggtcagcacgtacatggccgtgaccgtcggggccgattcgaggacgtccgtcggaagcgggggccgcacgcaggccgcctcgggacgcatcagcagcgcgccgagtttgtcggtgacggccgggaagcatagcgcgtactgcagcggcgttccgtccggggccaaaaagctggtggcgaacggcagatccagagcgctgacggcctcacgcagcaccaggggccccgggtctccgccggcgcgcagatacgcctcgccccggcggcgcagcagctgcgggtcgacctcgtggccctcgggggaagaagaggcccgggcgcgggcgtcgagggcgcgaagatcaacgagcaggggcgcgggcgcggactccgcgcccgcgcccgtctggccgccggccctggcgtacgcgctatataagcccatgcggtattggatgagttcccgcgcgccccggaactcctccaccgcccacggggccaggtccgcggccgccgcgtcgaactccgccagcaggcgccccagggcgtcaaagttcatctcccagggcaccctgcgcaccacctcatcccgcagccgggcgcacagggcggtgtgcttggtgacgcgcgcgcccagctcctccacggcctccgcgcgctcggcgcccttggcgcccaggacgccctggtacctggcggaaaggcgctcgtaggccggctgggcccgcagccccgacaccgtgttggtggtgtcctgcagggcgcgcagctgctcgtgcatggcgcggaacccctcgggggacttccaggcgcccccccggacgcggccaaagcgaccccagacctcgtcccactccgcctcggcctcctccagggacctccgcagggcgtcgacgcggcgccgagtatcaaagagcgcccccaggcggccggcgtgccgcgccagggggccggggccgtcgccgcgggcggcgcttagcgggtgcgtctcgaaggtgcgctgggcgtgctctagccagataaccgcgggcacgtcgagctcgcgcgttttctcggtctgatccaacagaacctcgacctggtcggcgatctccgccaccgagcgcgcctggtcgagcgtcttggccacggtcgccgggacggcgaccaccttcagcatggtcttgaggttggccaggccctcggcctcgatctgggcccggcgctcgcgcgcggccagcgcctcccgcaggcccgccatgacccgctcggtggcctccgcgcgctgctgtttggcgcgcaccactgcgtccttggtctcggccgtgtcctgccgggtcacgaaggcgacatactcggcgtacgccgtgttcttcacggggctctggtccacgcgctccaacgccgccgcgcacgcgaccagcgcgtcctcgctgggacacggcagggtgaccccggtccggaccagctccgcggtggcctccgggtcattccgggccgcggatatctgctccgcggcggccgccaggtccaggggcacgccgccgagcgcccggtgcacgtcggcccggatggcgtccaggcgatcgcggagctccacgtagtcggcgtagccatgttggaagaacggcacgtaccggcgcaggccgggcacgctcgtcatgtcgtccgccaggcgccccacggcctcgtggtagtcgataaacccgtcgcccgcctgggccatttccaggagcccctccgcgatgcgcagcagccgcgccaggggctcggcgtcgacccgaaacatgtcggcgtaggtttcggcggcggcgtggaacgccgcgctccagccgaggcggtggatggcggcgagcggggggagcatggggtggcgctggttctcgggggtgtaggggttaaacgcgaaggccgtatccagggcgagggtgaccgcctcggcgttggccgcgagcgcctgctcggcgcgcttgcggaagtcccgggggttgtagccgtgcgtgcccgccagcgcctgcaggcggcgcagctcgaccacgtcgaactcggcgcggttctcgacgcggtccagcgccgcctcgacgccggcggcccagcgctcgctgctgccccgggcgcgctgggccgccatcttcgccgtcaggtcggcgacggcggcctcaagttcgtcggcgcggcgtcgcgtggcgccgatgaccttgcccagctcctgcagggcgcgcccgctgggggaatggtccccggccgtcccttcggcgtgcagcaggcccccgaacccagcctcgtgccccgcgaggctttcccgagcagcggtcgtcgcgcgggccgcggcatcgatgagggcggcatggtccccctccggctgggcgcaggcccggcgcgcctggactaccaggtcggcggccgccgaccccagggtcgtgagctcgtcgatggccccccgcgcctccagggccagccgagtcgcctttacataccccgcggcgctatcggccagcaccgcgaggaaggacaggggcgaggccgggtcgcgggcggccgcgcccagggccgacaccgcgtccgccagggcgccatgcgcccgcacggccgcgtccaccgtcgccgcgggacttgccgtcgcgacggcggcgctcccggcgttgatggcgtttgacacggctttggcgattgtgggggcgtgatcggaaaagaactgcacgaggaccggcgtctcgggggcgtcggcgaacagggtcttcagcaccaccacgaaggcgggatgcaggccggccagagccgtcgcggtatccggggtcgggtgttccagggcctcccggtactgccccagcagcccccacaggtccgcccgcagcgccgccgtgacttccgggggggggccccggacggcatcggccaggtcggtccaccccgcgggcagggaggcccgcagggtcgccagcacggccggacacgcctttagccccacaaagtccgggaggggccgcaggaccccttggagtttgtgcaggaacttctcccgggcgtcgtgggccaccttggcgcgctcccgcgcgtcgttgagcatcgcctccagggcgtgggcgcgctcccgaagccgggagcgcgcctccggagcgagctccgccgtcatcttggccgcctccatggccctcgcctgccgcagcgcgtcttcggccatgcgcgtggcctcgggggacagcccgcccccgtcgacgtacggcgcggggccggtcgccgggacgaaggccgcgtcgctgtccagctgctgcgcgagcgccgcgtcgagggcgtcgaagcgctgcagttcggccagccccgagctgcgccgcgcctgctggtcgttgatgccgtggatgctgcgcgccagctcttccaggggcttgcgttcgatgagcccctgggtcgcggcgtcggtcaggaccgagagccaggccgccaggtcctcgggggcatctagggtctggccccgctggagcaggtcccgcagcaggatggcctgggggctggtggcgagggggggcgggggggggagcgcggcgcgctgagcgacgtcccgcgtgtgttggtcaaaggccggtagcgattccagcaactggaccatgggcacgaccgcggccgaggccacgtgaaaccgacagtcgtggctgtcgctggcctgcagggccttcgcgctgtatacggctccccggtggaagtactccttgaccgcgctctcgatcgcccggcgggcctggatccgcacgtcctccagccgcgcctggatggcctcggggcccagggcgggcgggcacggggccctgccgccggcgcccggggcggcgggcacgggcatcacggtcaggggcccggcgcgctgcgagaccgagtcgaccccgcgggcgagggcgtctaaggcctcgcgcatctcgcgggcctccgcctcgacccgcatctcttcgccccgggcaaactgggccagcgcctggatccgatggagaagcggctccgggtgcgtcggggtggcgggggcgaacagggtgttcgggtgggcgcgcgagcgctccaggagccactctccgaggcgtgcgtacagattggccggcggggcggcgcgcagctgcagatccaggtccgcgaggtccccgtaaaaggcgtccgtctcccgaataacgtccctggcgaccaggaccagcttagcgagggccaggcgcccgatctgcgaattttcgtccagcacgtgctggatgaggggccggtgggcggccacgtccgccaggctcatgcgcgtggacgccaggaagtccccgacggccgttttgcggggcagcatgcgcagggtgaagtccagcagggccgcggccgggccggccaccccggcctgcgtatgcgtgcgggccccgttctcgatcaaaaaggcgaggacgcgctcaaagaagaagatgacgcagagctccaacagccccgggtgcgccgggtacggcgaccgcagggcgttgatggtgagctgcgaacacgcggccacctcgcgggccagggcggcatcgcgcgccgcgagccggaccgccgtggcggccacattggggtggacctcgaacagctgcgccaggtcggcgccggggggctccggggggcggcgggcccccagcgtctcgagcacggacggcgacgacgggctcgcgggcccgtcgtcgccgccgccctgcccggactgcgggggggtatccggtgcgggagggaccgtggcggctatgggcgtcggggaggaggcggggacctcggcggcgacgggggccttcttcttgggcgcggacttcttcttggccttggcgggcggggccttgggggcgggcctctcgcccgaggtcagatcctccacgctggacggtggggtccaggtgggccggcggcgcttgggcaagccggtagaatagcgcgcccggtggcgacccaccggcactgcccccacctccaggacccgcaggtcctcggcttcttcggccgcgtccccggcgggtgtctgcgggggcggggcggcgtgcggtggacccgaggccgcggcgtccggggccgagggcttcgcgggcggggtcccctccagggctgctgcccacacatcatcgggggggcggtttgggtgccccgcctgcggtgtgtcgggtgggcccgaggccccccggggggcctcggggggccggtcggccccaggggtctggacgtgggtgggcgcggggagcgcggggacgaccgggcccgagccttctccgtcccccctggggaccacaccgacaaagagcgccccgagccccccgatctcgccccgcagggggtgggtgatggccacgcgccgctcgacgaacggttcgtcctgcaggtaagtctcgctggccccgtagaggtgcagggccgcggcggtcaggtccgccggcgccacggcccccgggccggagggcacaaaaaacaccatggcgcccgcccaccgcaccttggggcggtcgtgggcgtaatacgtcaggtacgggtacacgtcgcccgcccgcaccttggcgataaacgcgggcgttcccgcgggcaggccgtgcgggtcaaacagataggccgtgtcgccgtcccggtagagccccatgcccagggggccgatggtcaggagcgtgtaggacagcggccgcatggcccaggggccggcgaagaacgtgtgcgcggggcattgcgtctccagcagccccgccgtgggctccccgaagaagcccacctcgccgtacacccgcgaaaacacgcaacgcaggccgccgcgcgccgccgggtactccaggaagttggggagctcgataatggaacacatgcgcggcggcccggagcccgcggccgcgcgcgtccactcgcccccctccaccagacatccctcgatggcctccgcggacagcacgtcgcggggccccacgtcgaaaagaagactgagaaacgacagggacgagcgcatgcacgataccgacccccccggctccagatcggtcgcgaactggttccgaacaccggtgaccacgatatcgcgatccccctggcgcttcatcgtggggtgaggtagcgcggccggaatcatgtgtgccgcgcccgccacgagcggggcctgtttatgggccgggcgtcccgatgagtactgttgtttccgccgcccgaacccccccgcccatcaaccgcctgttcgtccccctaaccacacacccggtatcgcgtgtgtgtggtttcccgggaagacacatcccaccccatgaagttttgccctttttttccgtcccgcactacgccacctttccaccccccccccaaaaaaacaacaaccaactcccagatggatgggtgcgataataaagctttattattgtttaaccaaaggcgagtcctacgggtgtaccggtggtgtctcctgcggcgtcatctcgtcgtcctccacgggggtgttgggccaagggaccgtctcgcggcccgccgggcgcgtcgacggcgcgcgggcctgcgtgtcctgtgggccgggtgtcgtgggttcgggggtgctaccgccggcatcttgggcctccaggtccccgggggcccccgggccggcggaaggccgaaacgccgaggcgcgaaacacgccgtcggtgacctgcaggagctcgtttattaatagccagtccatgctcagcgtagcggccagcccctggggagacaggtccacggagtccggaaccaccgtcggctgacccaggggccccaggctgtagtccccccaggcccccaggtcatgacggttcgtgagcacgacgaggtctgcggccgggctggggggcgcgtcctcggtcgcgtgggccatcacctcctgaatggctgcggtgcgctgatcggccgagctggcgaagggcgccacgaccagcgcgcgctccgtctgcaggcccttccacgtgtcgtggagttcctgaacgaactcggccacccgctcggggcccgtggccgcgcgtgcggcctgatagccggccgagaggcgccgccagcgcgccaggaactgactcatgtaacagaacccggggacctggtcccccgacatcaactttgacgccctggcgtggatgcccgacacgatggccaggaacccgtggatttcccgccgcacgacggccagcacgttaccctcgtgcgagacctgggccgccagctcgtcgcataccccgaggtgcgccgtcgtctcggtgacgacggaccgcagccccgcgagggacgcgaccagcgcgcgcttggcgtcgtgatacatgccgcagtactggctcaccgcgtcgcccatggcctcggggcgccagggccccaggcgctcgtgggcgtctgcgaccacggcgtacaggcggtgcccgtcgctctcgaaccggcactcaaagaaggcggcgagcgtgcgcatgtgcagccgcagcagcacgatcgcgtcctccagctggcggaccagggggtcggcgcgctcggcgagctcctgcagcaccccccgggccgccagggcgtacatgctgatcagcagcaggctgctgcccacctcgggaggctgggggggaggcagctggaccgcgggccgcagctgctcgacggcccccctggcgatcacgtacagctcgcgcagcagctgctcgatgttgtcggccatctgcatcgtgggcccgacgccggcccgggtggccggttcgaggagggtgatcagcgcgcccaattttgtgcggtgcccctcgacggtggggagatagcccaggccgaagtcgcgcgcccaggccagcacccgcagggcaaactcgatggggcggggcaggtaggcagcgttgcacgtggccctcagcgcgtccccgaccaccagggccagcacgtaagggacgaaccccgggtcggcgaggacgttggggtggatgccctccagggccgggaagcggatcttggtggccgcggccaggtgaaccgagggggcgtggctaggcggcccgacggggagcagcgcggacagcggcgtggccggggtggtgggggtcaggtcccagtgggtctggccgtacacgtcgagccagatgagcgccgtctcgcgcaggaggctgggctggccggcgctgaagcggcgctcggccgtctcaaactcccccacgagcgtgcgccgcaggctcgccaggtgttccgtcggcacggccgggcccatgatgcgcgccagcgtctggctgaggacgccgcccgacaggccgaccgcctcacagagccgcccgtgcgtgtgctcgctggcgccctggatccgccggaacgttttcacgtagccggcgtagtgcccgtactcccgcgcgagcccgaacacgttcgcccccgcaagggcaatgcacccaaagagctgctggatctcgctgagcccgtggccggggggcgtccgcgcgggcacccccgccaccaaaaacccctccagggccgatatgtactgggtgcagtgcgcgggcgtgaaccccgcgtcggtaagcgtgttgatcaccacggagggcgagttgctgttctggaccaaagcccacgtctgctgcagcagcgcgaggagccgttgctgggccccggcggagggcggctcccctagctgcagcaggccggtgacggccggacggaagatggccagcgccgacgcactcagaaacggcacgtcggggtcgaagacggccgcgtccgtccgcacgcgcgccatcagcgtccccgggggcgcgcacgccgaccgcgggctgacgcggcttagggcggtcgacacgcgcacctcctcgcgactgcgaaccattttggtggcctcgaggggcgggatcatgatagccgggtcgatctcccgcaccgtgtgctgaaactgggccagcagcggcggcgggaccaccgcgccccgatcgggggtcgtcaggtactcgtccaccagcgccagcgtaaacagggcccgcgtgaggggggtcagggcggcgtcgtcgatgcgctgtaggtgcgccgagaacagcgtcacccaattgctgaccagggccaagaaccggagaccctcttgcacgatcggggacgggaagagcaggctgtacgccggggtggtcaggttggcgccgggttgccccaggggaaccggggacatcttaagcgacatctccccgagggcctccagggaggtccgcgggttcatggccaggcagctctgggtgacggtccgccagcggtcgatccactccacggcacactggcggacgcgcaccggccccagggccgccgtggtgcgcagcccggcggcctccagcgcgtgggtcgtgtcggagccggtgatcgccaggaccgtgtccttgatgacgtccatctcccggaaggccgcctcgggggtctcggggagcgccaccgccatgcggtgcaccagcagcccggggaggttctcggccaagagcgccgtctccggaagcccgtgggcccggtgcaaggcgcacagttgctccaggagcgggtgccagcacgcccgcgcctccgccgggccgaccgccgcgcccgacaacagaaacgccgccgtggcggcgcgcagtttggccgcggacagaaacgccggctcgtccgcgctgcccgccggctcgctcgagggggagggcggccggcggaggttggtcaggctccccaacaggacctgcaacggtccgtttgggggtggagcggacgggggggtcatgccggcgggcgccgggacctggagcgcgctgtccgacatggcgaccggcgtgcgcgctcggcgacgcggcgcggagaccgcgggcccaaacgggaatgactgccgccgccctatacggaggggctaagtatcgcccggggacccttcgaaaccccgggcgtgtcgcaagtacgccgcgaaggcgcggcgtgttatacggcgcgttatgtcccggcattccgttcgtgggttcgggcccgggtgctgtcgggtgggagtgtgtgtgggggggggcggcgcgacggcggcccggaccaagtgtatcgcggccgttccgtggggcggcccaacaggccctttaaacatttgcgtatgcaccggcccagccagtcggacaccggaacccaccagaggcggaagccgccttcgcccgtgagggtgcgtgtgttttctggtggcgtgtttttcctttccgccctcctccctccccacctccaccacccccccccacaactcgcccgttggcgatcggcgggaaaaccatgaaaaccaagccactcccgacagccccgatggcgtgggccgagagtgccgtggaaaccaccaccagcccgcgcgagctcgcgggccacgccccgctccggcgcgtcctgcgcccgcccatcgctcgccgcgacggcccggtgcttttgggggacagggcccccaggaggacggccagtacgatgtggctgctggggatcgaccccgcggagtcgtctccgggaacgcgcgctacccgagacgataccgagcaggccgtggacaagatcctcaggggagcccggcgcgcgggagggctgaccgtccccggcgccccccgctatcacctgacccgccaggtaaccctgacggatctctgccaaccaaacgcggagcgggccggggcgctccttttggccctgcggcaccccaccgacctcccccacctggcccgccatcgggctccgcccggccggcagaccgagcgactggccgaggcctggggccagctcctggaggcctccgccctggggtccgggcgggccgagagcggctgcgcgcgcgcgggccttgtgtcgtttaactttctggtggccgcgtgcgccgccgcctacgatgcgcgcgacgccgccgaggcggtccgggcccacatcacgaccaactacggcgggacgcgggccggggcgcggctggaccggttttccgaatgcctgcgcgccatggtccacacgcacgtgtttccccacgaggtcatgcggtttttcggggggctagtgtcgtgggtcacacaggacgagctggctagcgtcaccgccgtctgcagcggaccccaggaggccacacacaccggccacccgggcaggccccgttcggccgttaccatcccggcctgcgccttcgtggacctggacgccgagctgtgcctggggggccctggggcggcgttcctgtacttggtcttcacctaccgacagtgccgggaccaagagctctgttgcgtgtacgtggtcaagagccagctccccccgcgcggactggaggcggccctcgagcggctgttcgggcgcctccggataaccaacacgattcacggggccgaggacatgacgccccctcccccgaaccgaaacgttgactttccgctcgccgtcctggccgcgagctcgcaatccccgcggtgctcggcgagccaagtcacgaacccccagtttgtcgacaggctgtaccgctggcagccggatctgcgggggcgccctaccgcacgcacctgcacatacgccgccttcgcagagctgggtgtcatgccagacgacagcccccgctgtctgcaccgcaccgagcggtttggggcggtcggcgttccggttgtcatcctggagggcgtggtgtggcgccccggcgggtggcgggcctgcgcgtgatcgtctattgacgacggccgcccaacccgagcgaccttcccctcccacttccccccccctacacaccaactccgccctcgccgtcttggccgtgcgcggccccgtgcgtccgtctcaataaagccaggttaaatccgtgacgtggtgtgtttggcgtgtgtctctgaaatggcggaaaccgacatgcaaatgggattcatggacacgttacacccccctgactcaggagataggcatatcctccttagattgactcagcacacgatcgcaccccacccctgtgtgccggggataaaagccaacgcgggcggtctgggttaccacaacaggtgggtgcttcggggacttgacggtcgccactctcctgcgagccctcacgtcttcgcccaccgattcctgttgcgttcctgtcggccggtgctgtcctgtcgacagattgttggcgactgcccgggtgattcgtcggccggtgcgtcctttcggtcgtaccgcccaccccgcctcccacgggcccgccgctgtttccgttcatcgcgtccgagccaccgtcaccttggttccaatggccaaccgccctgccgcatccgccctcgccggagcgcggtctccgtccgaacgacaggaaccccgggagcccgaggtcgccccccctggcggcgaccacgtgttttgcaggaaagtcagcggcgtgatggtgctttccagcgatccccccggccccgcggcctaccgcattagcgacagcagctttgttcaatgcggctccaactgcagtatgataatcgacggagacgtggcgcgcggtcatttgcgtgacctcgagggcgctacgtccaccggcgccttcgtcgcgatctcaaacgtcgcagccggcggggatggccgaaccgccgtcgtggcgctcggcggaacctcgggcccgtccgcgactacatccgtggggacccagacgtccggggagttcctccacgggaacccaaggacccccgaaccccaaggaccccaggctgtccccccgccccctcctcccccctttccatggggccacgagtgctgcgcccgtcgcgatgccaggggcggcgccgagaaggacgtcggggccgcggagtcatggtcagacggcccgtcgtccgactccgaaacggaggactcggactcctcggacgaggatacgggttcggagacgctgtctcgatcctcttcgatctgggccgcaggggcgactgacgacgatgacagcgactccgactcgcggtcggacgactccgtgcagcccgacgttgtcgttcgtcgcagatggagcgacggccccgcccccgtggcctttcccaagccccggcgccccggcgactcccccggaaaccccggcctgggcgccggcaccgggccgggctccgcgacggacccgcgcgcgtcggccgactccgattccgcggcccacgccgccgcaccccaggcggacgtggcgccggttctggacagccagcccactgtgggaacggaccccggctacccagtccccctagaactcacgcccgagaacgcggaggcggtggcgcggtttctgggggacgccgtcgaccgcgagcccgcgctcatgctggagtacttctgtcggtgcgcccgcgaggagagcaagcgcgtgcccccacgaaccttcggcagcgccccccgcctcacggaggacgactttgggctcctgaactacgcgctcgctgagatgcgacgcctgtgcctggaccttcccccggtcccccccaacgcatacacgccctatcatctgagggagtatgcgacgcggctggttaacgggttcaaacccctggtgcggcggtccgcccgcctgtatcgcatcctgggggttctggtccacctgcgcatccgtacccgggaggcctcctttgaggaatggatgcgctccaaggaggtggacctggacttcgggctgacggaaaggcttcgcgaacacgaggcccagctaatgatcctggcccaggccctgaacccctacgactgtctgatccacagcaccccgaacacgctcgtcgagcgggggctgcagtcggcgctgaagtacgaagagttttacctcaagcgcttcggcgggcactacatggagtccgtcttccagatgtacacccgcatcgccgggtttctggcgtgccgggcgacccgcggcatgcgccacatcgccctggggcgacaggggtcgtggtgggaaatgttcaagttctttttccaccgcctctacgaccaccagatcgtgccgtccacccccgccatgctgaacctcggaacccgcaactactacacgtccagctgctacctggtaaacccccaggccaccactaaccaggccaccctccgggccatcaccggcaacgtgagcgccatcctcgcccgcaacgggggcatcgggctgtgcatgcaggcgttcaacgacgccagccccggcaccgccagcatcatgccggccctgaaggtcctcgactccctggtggcggcgcacaacaaacagagcacgcgccccaccggggcgtgcgtgtacctggaaccctggcacagcgacgttcgggccgtgctcagaatgaagggcgtcctcgccggcgaggaggcccagcgctgcgacaacatcttcagcgccctctggatgccggacctgttcttcaagcgcctgatccgccacctcgacggcgagaaaaacgtcacctggtccctgttcgaccgggacaccagcatgtcgctcgccgactttcacggcgaggagttcgagaagctgtacgagcacctcgaggccatggggttcggcgaaacgatccccatccaggacctggcgtacgccatcgtgcgcagcgcggccaccaccggaagccccttcatcatgtttaaggacgcggtaaaccgccactacatctacgacacgcaaggggcggccatcgccggctccaacctctgcaccgagatcgtccacccggcctccaagcgatccagtggggtctgcaacctgggaagcgtgaatctggcccgatgcgtctccaggcagacgtttgactttgggcggctccgcgacgccgtgcaggcgtgcgtgctgatggtgaacatcatgatcgacagcacgctacaacccacgccccagtgcacccgcggcaacgacaacctgcggtccatgggcattggcatgcagggcctgcacacggcgtgcctgaagatgggcctggatctggagtcggccgagttccgggacctgaacacacacatcgccgaggtgatgctgctcgcggccatgaagaccagtaacgcgctgtgcgttcgcggggcgcgtcccttcagccactttaagcgcagcatgtaccgggccggccgctttcactgggagcgcttttcgaacgccagcccgcggtacgagggcgagtgggagatgctacgccagagcatgatgaaacacggcctgcgcaacagccagttcatcgcgctcatgcccaccgccgcctcggcccagatctcggacgtcagcgagggctttgcccccctgttcaccaacctgttcagcaaggtgaccagggacggcgagacgctgcgccccaacacgctcttgctgaaggaactcgagcgcacgttcggcgggaagcggctcctggacgcgatggacgggctcgaggccaagcagtggtctgtggcccaggccctgccttgcctggaccccgcccaccccctccggcggttcaagacggccttcgactacgaccaggaactgctgatcgacctgtgtgcagaccgcgccccctatgttgatcacagccaatccatgactctgtatgtcacagagaaggcggacgggacgctccccgcctccaccctggtccgccttctcgtccacgcatataagcgcggcctgaagacggggatgtactactgcaaggttcgcaaggcgaccaacagcggggtgttcgccggcgacgacaacatcgtctgcacaagctgcgcgctgtaagcaacagcgctccgatcggggtcaggcgtcgctctcggtcccgcatatcgccatggatcccgccgtctcccccgcgagcaccgaccccctagatacccacgcgtcgggggccggggcggccccgattccggtgtgccccacccccgagcggtacttctacacctcccagtgccccgacatcaaccaccttcgctccctcagcatcctgaaccgctggctggagaccgagctcgtgttcgtgggggacgaggaggacgtctccaagctctccgagggcgagctcggcttctaccgctttctgtttgccttcctgtcggccgcggacgacctggtgacggaaaacctgggcggcctctccggcctcttcgaacagaaggacattcttcactactacgtggagcaggaatgcatcgaggtcgtccactcgcgcgtctacaacatcatccagctggtgctctttcacaacaacgaccaggcgcgccgcgcctatgtggcccgcaccatcaaccacccggccattcgcgtcaaggtggactggctggaggcgcgggtgcgggaatgcgactcgatcccggagaagttcatcctcatgatcctcatcgagggcgtcttttttgccgcctcgttcgccgccatcgcgtacctgcgcaccaacaacctcctgcgggtcacctgccagtcgaacgacctcatcagccgcgacgaggccgtgcatacgacagcctcgtgctacatctacaacaactacctcgggggccacgccaagcccgaggcggcgcgcgtgtaccggctgtttcgggaggcggtggatatcgagatcgggttcatccgatcccaggccccgacggacagctctatcctgagtccgggggccctggcggccatcgagaactacgtgcgattcagcgcggatcgcctgctgggcctgatccatatgcagcccctgtattccgcccccgcccccgacgccagctttcccctcagcctcatgtccaccgacaaacacaccaacttcttcgagtgccgcagcacctcgtacgccggggccgtcgtcaacgatctgtgagggtctgggcgcccttgtagcgatgtctaaccgaaataaaggggtcgaaacggactgttgggtctccggtgtgattattacgcaggggaggggggtggcggctggggaaagggaaggaacgcccgaaaccagagaaaaggaccaaaagggaaacgcgtccaaccgataaatcaagcgccgaccagaaccccgagatgcataataacgattttattactcttattattaacaggtcgggcatcgggaggggatgggggcgcgcgtttcctccgttccggctactcgtcccagaatttagccaggacgtccttgtaaaacgcgggcgggggcgcgtgggcccacagctgcgccagaaaccggtcggcgatgtccggggcggtgatatgccgagtcacgatggagcgcgctaaatcttcgtcgcggaggtcctgatagatgggcagtctttttagaagagtccagggtccccgctccttggggctgataagcgatatgacgtacttgacgtatctgtgctccaccagctcggcgatggtcatcggatcgggcagccagtccagggcctccggggcgtcgtggatgacgtggcggcgacgtccggcgacatagccgcggtgttccgcgacccgctgcgcgttggggacctgcacgagctcgggcggggtgagtatctccgaggaggacgaccgggcgccgtcgcgcggcccaccggcgacgtccgggggctggaggggggggtcttcttcgtagtcgtcctcgcccgcgatctgttgggccagaatttcggtccacgagatgcgcgtctcgaggccgaccggggccgcggtcagcgtaggcatgctctccagggagcgcgagttggcgcgctcccgccgggccgcccggcgggcctgggatcggctcggggcggtccagtgacactcgcgcagcacgtcctcgacggacgcgtaggtgttattggggtgcaggtctgtgtggcagcggacgaacagcgccaggaactgcgggtaactcatcttgaagtactgcagcaggtcgcggcagtgaatcgtcggaatgtagccggtgctgatgtccaacacgatatcgcagcccatcagcaggagatcggtatccgtggtatgcacgtacgcgaccgtgttggtatgatagaggttcgcgcaggcgtcgtcggcctccagctgacccgagttgatgtaggcgtaccccagcgcccgcagaacgcggatacagaacaggtgagccaggcgcagggccggcttcgagggcgcgcccgagggggccgccgggcctgggccggcggcccgcgttccccggtcccccggggcgaaggcgtgcccgcggcggcgcatgttggaaaaggcgaaactgggcctggagtcggtgatgggggaaggcggcggcgaggcgtctacgtcactggcctcctcgtccgtgcggcactgggccgtcgtgcgggccaggatcgccttggccccgaacacaaccggctcggtacactcgaccccgcgatcggtcacgaagatggggaacagggacttttgggtaaacacccgtaacatactacagagacagtgtagcgtgattgcctcgcggtcgtaacttgggtagcggcgctgatatttaaccaccagggtatacatgacattccacaggtccacggcgatgggggtaaagtagccctccggggcccggaggccccggcgcttcaccagatggtgagtctgggcaaacttcatcatgccaaacagacccattccggcacgattgtaggtgcggataggtctctctacagagctgtataggtgtgacggtccgggacacccaagcccgccgcccctgtgtacagtggctgcggcgacgaccccgctccaacaagacgctatcccgggaaaggcacgctctttataattcttttttatttcccatctacgtgcggattggtgcaaccgccggcgcgcgccggtgcaggccgaccatctctctcttccccccctccccctcccccgagccctcaaagagggtgtggcctaactagcggaaggcgtatttaaccagactagggcggcgggtccgccgtagtccttggctcgggtagccactgctctgtggctcgggtcccccggcccccctaacccccatccggtccgcgtcatccgccccctccgcctgcgacacaaacggccgcgcctccgggcccggtgacacgacgcgcctcgtctctgcggattgtcccgggagcgtcgcggcatggctcatcttcccggcggtgcggccgccgcccccctttcggaggacgcgatcccgtcgccgcgcgagcggacggaagactggccgccctgccagatagtgctgcagggcgccgagctgaacgggatcctgcaggcctttgcgccgcttcgcacgagccttttggactcgctcctggtcgtgggcgaccgaggcatccttgtacataacgcgattttcggcgagcaggtgtttctgcccctcgaccattcgcagttcagtcgctatcgatggggcggacccaccgcggcgttcctgtctctcgtggaccagaagcgatccctgctgagcgtgtttcgcgccaaccagtaccctgacctgcggcgggtggagctgacggtcacgggccaggccccgtttcgcacgctggtgcagcgcatatggacgaccgcgtccgacggagaggccgtggagcttgccagcgagacgctcatgaaacgcgagttgacgagcttcgcggtactactcccccagggcgaccccgacgtccagctgcgcctcacgaagccccagctcacgaaggtggtgaacgccgtcggggacgagaccgccaaacccaccacgttcgagctcggccccaacggcaagttttccgtgtttaacgcgcgcacctgcgtcacctttgccgcccgcgaggagggcgcgtcgtccagcaccagcgcccaggtccagattctgaccagcgcgctgaagaaggcgggccaagcggccgccaacgccaagacggtctacggggaaaacacacaccgcacattctcggtggtcgtcgacgactgcagcatgcgggcggtcctccggcggctccaggtcggcggggggaccctcaagttcttcctcacggccgacgtccccagcgtgtgtgtcaccgccaccggccccaacgcggtgtcggcggtgtttcttttaaaaccccagcgggtctgcctgaactggctcggccggagcccgggttcctcgaccgggagcttggcgtcccaggactctcgggccggcccgaccgacagccaggactcctcctccgagccggacgcgggcgaccgcggcgccccagaagaagaaggcctcgagggccaggcccgggtaccgcccgcgttcccggaaccgccgggaaccaagcggaggcaccccggggccgaagttgtccccgcggacgacgccaccaagcgcccgaagacgggcgtgcccgccgcccccacgcgagccgagtcgccccccctctccgcgagatacggacccgaggcggcggagggtggtggggacggcggccgctacgcgtgctactttcgcgacctccagaccggcgacgcgagccccagccccctctccgccttccggggtccccaaagacccccatacggctttgggttgccctgacggcaacgggtggtggccgaacgcctcaccgcgcccgggcacgcggggtgcgttgtgttaaaaaaataaataaatggggtagtgtgtcccccccccctccaaccaatatggctgtcgtgtgtggttccgggttgcgcctccgtcctttccaccccccttccccctccttttttgttttgcgtgcgcttataagagcgggcccggggcccttcgcagcttcaccgagagcgccgtcgggccccgggtgcgggatgtgtcgcggggacagccccggggtcgcgggcgggagcggcgaacactgcctcggaggggatgatggggacgacgggcgcccccgcctcgcctgcgtgggtgccatcgctcgggggttcgcgcatctctggctccaggccgccacgctgggcttcgtggggtctgtcgttctgtcgcgcggcccgtatgcggacgccatgtcgggggcgttcgtgatcgggagcaccggcctggggttcctccgcgccccccccgcgttcgcccggccgccgacgcgtgtgtgcgcgtggctgaggctggtcggcgggggagcggccgtggccctgtggagcctcggggaggccggcgcgcctccgggggttccgggcccggcgacccagtgcctggcgctcggggccgcctacgcggcgctgctggtgctggccgacgacgtccatccccttttcctcctcgccccgcggcccctgtttgtcggcaccctgggggttgtcgtcggcgggctgacgataggcggcagtgcgcgctactggtggatcgacccccgcgccgccgcggccctgacggcggcggtggtggcgggcctcgggacaaccgccgccggggacagcttttccaaggcctgtccccgccaccgccgcttttgcgtcgtctccgcggtcgagtctcccccgccccgatacgccccggaggacgccgagcggccaacagaccacggacccctgttaccgtcgacgcaccaccagcgatctccgcgggtctgcggcgacggggccgcacggcccgaaaacatctgggttcccgtggtgacctttgcgggcgcgctcgcgctggccgcctgcgccgcgcgagggtctgacgcggctccgtcaggcccggtcctgccgctgtggccccaggtgtttgtcgggggccacgcggcggcgggcctgacggagctgtgtcagaccctcgcgccccgggacctcacggacccgctgctgtttgcgtacgtcggattccaggtcgtgaaccacgggctgatgtttgtggtccccgacatcgccgtatacgcgatgctggggggcgccgtgtggatctcgctgacgcaggtgcttgggctccggcgccgccttcacaaggacccagacgccgggccctgggcggccgcgaccctgcggggcctctttttctccgtctacgcattggggtttgcggcgggggtgctggtgcggccgcggatggcggcgagccggcggtcggggtgatcgccatttcaaataaaaggcacgagttccccgaataccaccggcgtgtgatgatttcgccctaccgctccgatccccggggggaggggggaaggaaatgggggcgggggtgccgtggacgggtataaaggccaggggggcaggcgggcccatcactgttagggtgttaggttgggaggtggcacaaaaagcgacactcccgtgttgtagttgtccgcgggaggcggtggtttccggcaaccctcctcgctgcgccgggcgcgcccaccggtccttcgcgggggccggggctcttctggtcatggcccttggacgggtgggcctagccgtgggcctgtggggcctgctgtgggtgggtgtggtcgtggtgctggccaatgcctcccccggacgcacgataacggtgggcccgcgggggaacgcgagcaatgccgccccctccgcgtccccgcggaacgcatccgccccccgaaccacacccacgcccccccaaccccgcaaggcgacgaaaagtaaggcctccaccgccaaaccggccccgccccccaagaccgggcccccgaagacatcctcggagcccgtgcgatgcaaccgccacgacccgctggcccggtacggctcgcgggtgcaaatccgatgccggtttcccaactccacccgcacggagttccgcctccagatctggcgttatgccacggcgacggacgccgagatcggaacggcgcctagcttagaggaggtgatggtaaacgtgtcggccccgcccgggggccaactggtgtatgacagcgcccccaaccgaacggacccgcacgtgatctgggcggagggcgccggcccgggcgccagcccgcggctgtactcggtcgtcgggccgctgggtcggcagcggctcatcatcgaagagctgaccctggagacccagggcatgtactactgggtgtggggccggacggaccgcccgtccgcgtacgggacctgggtgcgcgttcgcgtgttccgccctccgtcgctgaccatccacccccacgcggtgctggagggccagccgtttaaggcgacgtgcacggccgccacctactacccgggcaaccgcgcggagttcgtctggttcgaggacggtcgccgggtgttcgatccggcccagatacacacgcagacgcaggagaaccccgacggcttttccaccgtctccaccgtgacctccgcggccgtcggcggccagggccccccgcgcaccttcacctgccagctgacgtggcaccgcgactccgtgtcgttctctcggcgcaacgccagcggcacggcatcggtgctgccgcggccaaccatcaccatggagtttacgggcgaccatgcggtctgcacggccggctgtgtgcccgagggggtgacgtttgcctggttcctgggggacgactcctcgccggcggagaaggtggccgtcgcgtcccagacatcgtgcgggcgccccggcaccgccacgatccgctccaccctgccggtctcgtacgagcagaccgagtacatctgccggctggcgggatacccggacggaattccggtcctagagcaccacggcagccaccagcccccgccgcgggaccccaccgagcggcaggtgatccgggcggtggagggggcggggatcggagtggctgtccttgtcgcggtggttctggccgggaccgcggtagtgtacctcacccacgcctcctcggtgcgctatcgtcggctgcggtaactccggggccgggcccggccgccggttgtcttcttttccaccccttccgtcccccgtacccaccacaccccaccccacccccccgccgtcccccgggcgttataagccgccgcactcgcttttcccaccggaaaatcctcggcccgatccgaacggcgcacgccgcgtgggctccaaacgcctccggaagagagcgccccgccccgatattcaagcccgcggtggtgctatggctttccgtgcttcgggacccgcctaccagcccctcgcccccgcggcctccccggcgcgggctcgtgttccggccgtggcctggatcggcgtcggagcgatcgtcggggcctttgcgctcgtcgccgcgttggttctcgtaccccctcggtcctcgtggggactctcgccgtgcgacagcggctggcaggaattcaacgcgggatgcgtcgcgtgggaccccacccccgtcgagcacgagcaggcggtcggcggctgcagcgcgccggccacccttatcccccgtgcggccgccaagcacctggccgctctgacacgcgtccaggcggagagatcgtcgggttactggtgggtgaacggagacggcatccggacctgtctgagactcgtcgacagcgtcagtggcatcgacgagttttgcgaggagctcgcgatccgcatatgctactacccacgaagccccggcgggtttgtccgcttcgtaacttcgatacgtaacgccctggggttgccgtgaggcgcgcgtccgacggtcccgcttctcgcctctcttcttcccccaccccacccaccgaccaacgacggcgtttggccaataccctccttttttctttttctcttccccccccccccaaaaaaaacaataaacagctaattgcgtacgacaaaccatgcggaactcgctgttttttttctctgtttgttactttttattgaaacagacatacggggaaaggggccggaaaccgagacggtggggccggcggtcgcatttttttaatggctctggtgtcggccgcgtttgagcttcgtcaacagggcgctgagggcggcgacgttcgtcgggccgtcgttggccagcgcgttggtccgggggcgggcgggcatgggcgacaggcttagtcccgggtccggggcgcgtgtggcccccggaggggagaagagggcagacccgccccagtcgtacaggggattttccgcctcgatgtacggggagtccggggcgtctcccggcagggcggccccgccggcaagacgccggcgagggcagatgttttcgtatacccgaacccaggggatctcctcgtagacgcgccccccatcctcgcccaccgactcgtaaatggaatctgcgtcctcggagggggcgcggggggcgtggctttcggccggccaggcggcggcggcggtggtgtcggcggcgggggtggcgccaagcccgacgcccgcgggcatggcggcgtcatcgtcgggcagcagatacgtgttttccatctggtccggttcggcctccgcgtccggcccccaggtccgcaccgcgtcgtagaccccggcggcctcgcgctgagccgcgagcgggcgcgccgcggctgccggccgctgctcggggggcgcggggttgcggggcgggaggcgcgggggcgccccggccatatgcgtgtaatacgtggccggccggccggcgcagggctcgggaccccggtcggccgcgtcgacgtgcgggggctcggggaggtcctcgcggtggcgcctgaacctccgaggggccgcgggggtcgagtgggggcgagcccgggggagcggcgggggtgcgttgtcgcgccgggtccgttgtatcttgtcccggcagctcccgccgaccgcgccgcggccccccggtgggccggacgccgcgaggcgcaggatggactcgtagtggggcgacggggttccgctccgaagcaggtccggggccagggcggccccgaaccaggacttgatgctgagttccatccgggcccagctcggggcggtcatcgtggggaacaggggggcggcggtcctgcagaagcgctcctggctgtccaccgccgcccgtaggtactcgttgttcaggctgtcggaggcccagacgacatacccggtaagcgtcgcgttaattatatactgggcgtggtggtggactatggatagaacctcgacggtcgagacgatggcgtccacgatcccgtacgtgccgccgctgcgcttgccggtctcccacaggtgggccaggcgcgtcaggtggcccaggacgtcgctgaccgccgcccgcagggccatgcactgcatcgagcccgtggtgccgctgggcccgcggtccaggtggcgcgcaaacgtctccgcgggcgcctccagactcccgctgagcgccacgaaccggcgatcggcggggcccaggcggcgacacacgtacttgtccgccgtccacagcatccacgaggcccaatggtacaacacggagacgtaggccaggagctcgctcagccgcagtgcggtgtccgtgctcggccggctcgggtctgcggggcgcataaagaacatgtactgctggagcctgtgggccgcgtcgcgcaaccccgccaccgcggcggcgtacttggccgcggcggccccgctcttgaacggggcgcgcaccagcagcttcgggagcagggtgggccgcagcagcacgtgcaggctggggtcgcagtcgcccgccgggtcgtcggggatgtccaggccgctgggcacgaccgtctggaggtacttccagtactgcgctaggatggcgcggctcagctggccgcccgacagctccacctcgccgagcgcctgcttggcggccgacgcgtagtgccggatgtagtcgtagtgcgggtcgctggcgagcccgtctacgatcaggctctcggggacggtgttatggtgccgcgccgccagccggacgctgcgatcggcgccggtcagaaacgccggctgcaggtcgtcggcgcgctgccgcaggacgcccacggccgcgctgaggagcccctccggggtggggagcagacacccggcgaagatgcgccgctcggggacgcccgcgttggcgccgcggatgaggttggccggcgtcaggcaccgcgccagccgcagggagctcgcgccgcgcgcccggcgttgcatggcggagaccgttcggtcgggggccccgccggtcggaggtatgccgcgtcccgggatatagggttgctttttatggggaggcgcctatgggcgtggcgggccgcccagcccggtcgcgcgcctcccggacacgtgcgcccggagggcggcggtctcctcgtcgcccatgagcagtttccgaaactgcgccatgatgtccacgacgcggacccgcggccccagcacggactcgctattcaggggggcgggggggaaggccgccaggtcttcgagcaggaaggcggggtctgccgtcccgctcacgggcgcccggggcgccgaggacgcggggcgaaggtccacgtgttccgcggcggcgcgcacgtccgcccaaaatttggcgggggtggtccgcgcgtacaggggctgggtcgcgcggaggacgcacgcgtagcgcaggggggtgtacgtgcccacctcgggggccgtcgacccgccgtcaaacgcggccagggccacgcacgcgaccaccgtgtcggccaggcccagcagccgctgcaggatgagccccgtcgccagcacggcgcgcgcggccgccgcgtcgtccctgcgccggcgcgcgtccccgcaggccagggcgtatttcagggtaacggtcgccagggccgtgtgcagcgcgtacacggccgcgcccagcacggcgttcagcccgctggtggcgagcaggcggcgcgccgcggtgtcgcccagcgcctcgtgctcggccgccacgaccccggggctgcccaggggcagggcgcgaaacagcgcctcctgctccacgtccgcaaacgcggggtgggcggagtgcgggtgcaggcgcgcccccacgaccaccgagagccactggaccgtctgctccgccaggaccgccagcacgtccaggacgcgccccgcaaacgcggcctcccgcgggagcacgcatttgacggcgccggggttgaagcgggcgagcagagccccggtggcgatgtacgtcatgcgccccgcgtagcgggcggccacgcgacagtcgcgccccaggagcgcgcgcaccccgggccagtacagcagggaccccagcgaactgcgaaagaccgcggcgtcggggccggggtgggggggcgcggcccctcccgcgctgagcagcggcacggcggcggcccccacgggccgcaacgccgtgaggctcgcgaactgccgtcggagctcggccgccctgtcgtcgagctccgagccgcgcccctccgtgtgcaggcgcgtcccgcagacccacccgttgatcgccacccgcacgatggcgtccaccagaaagcccatcgcgcgggaggggctggtttttgcccgccgatccgtcaggtcgaggatcgcgtcgcccgtgacgtaccaggccagcgcctcgccctgctgcagcgtctggcggaaaaacacctttgggtcggccggggaggcaaagtgcatgacccccacgcgcgacagcccgaacgcgctatccggacacgggtagaacccggccggatgtcccagggccagggccgagcgcacggactcgtcccacgcggcgactcggggggtcaggcggtccagggggaatgccgcctgcagctccgggcccgacacgcggcccgcgagaatctcgaccgtcgcggaaggccgcgccccggcgccgtcatcgtgcgcgacggcggcggggtagtcgtcctcctcgtagttgagctcgtccaggaacagcggcgagggcaccacccgcgaaccgcccacccgccccaaaacgtcgcgtgggtccatcgggcccaggtagcctccccgcggggcccgcgtgatggcgctgtcccggcgtccgcgaacggactggctcctggccgtaacggacctggggcgcggaaaggacgcccggcgggggggcgccgccgcccgggcctcggacgcgcgtcgggacccggggtgaccgcgggcctcccggcgacggcgcgggggcggctcttcgctcgccatctcccccgcggcctcgacctcgctgtcgtcgtccacgttaaacaccgcccgcaggtaccccattaacccgactccaccgccctcgggctcgtcctccacgggcgagtcggcgcgatgcgcggacggggcatgggaccgggtggaggcgcgcctccggcgtacggcatgcccgcgcacggacatggtggccggaggcccgattttttacacacgccctccccgcagacggacgaggaaaggggtggtgcgaggggggaggcccaaacggggaggtggggggtagggggcggtcccagggagcggggggtaggaaccggcacgacgggaacagagaaaacgcgaccgctccaacaagggtgggggggtgggcctcgtccccacgcagacccgcgggcaaatgcgagaacgggacccgcgcgcctgcctttatacgcggaccccagcaccacgagccgttctgtgacgcgaatctacacgaccgcgggctcgtaggcgcgactaacgcccaacccaacggcacacaccccccaccccgcgcgtaaccccatttctttcatggtcccgtaataaacagccaacgcacgccgcgtatgatgagttgcttgccaatgtttattgctgtggttgcgaaccctctatcgcgatacagacggaggtgaggcggggcggtggtgggggggggcgcgccgcccggtcgcacatcctaccccccaaagtcgtcaatgcccatggcatcggtaaacatctgttcaaactcaaaatcgtccacgtccaaagccccatacgagacggggtcgtgggtcattcccggggagggggactccacgtcccccagcatctccaagtcgaagtcgtccagggcgtcggcgggcgtcatatccacctcctcgccgtccaggcggagttcgtctcccaggctgacgtcggtaatgggggcggtggtggacagtctgcgggggcgttgtcccgcggagagaaacgacatgcgcggcgccaccagcccggcctccgcgggagcgtcatcgtcgtccgggaggtcgagcaggccctcgattgtcgatccgtaattgtttctggtccgcccgcggctatacgcgtgctcccgcatgacggactcgccctccgaggtcgcgacgctggagtacgagtccaacttggcccggatcagcagcataaagtacccagaggagcgggcctggttgccctgcaggacgggcggggtcgtgaggggcgccccgggttcctccgccgccgcacttcgcaccagcgggaggttcaggtgctcgcgaatgtggtttagctcccgcagtcgccgggcctccacgggaactccccgcacggtgagcgatccgttgataaacatcaggggctgaaacagacacgccaactggcgccagctctccaggtcgcagcagaggccgtcgaacagatcgggccgcatcatctgctcggcgtacgcggcccataggatctcgcggctcagaaagaggtatagatgcagaaacaggacgcgcgccaggcgcgcggtctcgcggtagtacctgtccgcgatcgtggtgcgcagcatctcccgcaggtcgcggttgcggccccgcatgtgtgcctggcggtgtagctgccgaacgctggcgcgcaggtaccggtacagggccgagcaaaaatttgccaacacggtccggtagctctcctcccgcgcccgcagctcaccgcggaaaaactgcgccatggcctcgtagtacgaaggcagctcgtcgcgggtggcgggcagggtggggaacgccacgtcgccgtgggcgcgaatgtcgatcggggagcgctcggggacgtgcgcatccccccagtcgatcacgtcgctgggcagcgtcgacagaaacttgcactcccggtacatgtcggcgttggtcgggaacccagagaacaggtcctcgttccaggtatctagcatggtacacagcgcgggacccgcgctgaagcccagatcgtcgaggagacggttaaacagggccgcgggggggacgggcatgggcggcgagggcatcagctgggcctgactcagccgaccggtggcgtacagcggaggggcggctggggtgttcttgggacccccggctggcctggggggcggtggcgaaaccccgtccgcgtccgcaaacagatcgtcgaccaacaggtccatgggggcggttgggtccgggaataacgatctcgagaggcgaatgagacgtgcccgagcgcccggcggcggagagggggggagggatccgggacccgcgacagaaaaaggccggggccctcgcgaagggaatcgccgggggtgccgtgcgtccccgaggactgacatctcgcgtccaccaccccgcatttaagtatcaccccagtgccgccccaaacctcgtgacttccccaccgctccgggcggcccgtcccccgcgctcggaagggaggcgtgtccttcctcccgcccctcccgcccctcccgcccctcccgcccctcccgcccctcccgcccctcccgcccctcccgcccctcccgcccctcccgcccctcccgcccctcccgcccctcccgcccctcgccacaaacgcgtgctgacagcgaagtggttaaatcgaccgtgatgctttattgtctgtcgtctgaacgcggtcggggtcgctactcgagggggcggcggggacgggaagccgagcgggcgggggcccgtgcggtcgcggcggcacgccccgcggggcggccccgggcggccgcggtcgcgtcgacgtcctgcgccgcgtcgggattcaccaactcgttcgcgcgctgcaggaggttcttgccctcgcagaccgtcacgcgaatggtggtgaggtcgaggagctcgttgaggtcttcgtcggtgtgcggccgcgacatgtcccacagctgtaccgccgccagccgggcgtgcgtggccgccaggcgcccgaccgcggcgcagaagacgcgcttgttgaacccggccacccggggggtccacggcgccgtggggctcggtggggcggtgctgaagtgcagcttcttggccagtccctgggcgggtgtcttggttcttcccgaggccgtgggagcgggggcgtctaggagcacggcggagtcggcctgggcgggtcgcctgccgcgggcggggtcggtcgccggggtcgcggaggccttaggcgccccgcgcgtcattttgggggtccgcgcgggaggggcgtgcgagcgcccgccggcgcccacggggcccccggggggtggaggagcgcgcgcggggccggggccgtgagagcccgcgacggacgccgaacgacgcggtcgcgcggtatcccgggactcgtcgtcgtccgaagacgagtcccggtagagggcatacccagcctcgtcataatggagaaagcgaacctcgcccctcgggcgcgcgcgcatcgggccagcgccgcggcggaagtcgtcgcgcggactctctgggtccgccggggagaccgggccatagtacagctcctcgtgggtcccgcgcggcgcttcccgcggacacgacttgacggagcggcgagaggtcatggtctatcggagacaccggggacgcccgtgcggatcacagggaaggcgtcggcgaaggaggcagagagcgtcggaaggcggcgagggagggaaagagggagaccggcggggtacgggagagcagcgagggcctgcgtaacccacgggggccgcgggagtggctccctgcgggttgcgggggagagtttataggaagtggatataaccgcaggcgacgggactaaccaatccccgggggggcaacggacagacacgccccgaacaggcccgacttccgcgaggaagcaaaggccgggggccgcccaacgacacgcccaccccttcccaacagggcgggctcaggctgacccggcggccagtgcccgctgacatatctgatacacgtgcgcgatcatacatacgcccatcgaggtcatgcctagataaaagggcaccaggacccccgggacggacaccacaccggcgctgtcgccccggcattgcgcgtccccgataacgccgcgtgcgcctgccgcgttcggcggctccccgggcacgcccgcgacgagcgcgacgaacaacagcaccacccagcggcccagtcttgcgggtttccccgtcatcgcggcgatgagtcagtgggggcccagggcgatccttgtccagacggacagcaccaaccggaatgccgatggggactggcaagcggccgtagctattcgcgggggcggagtcgttcaactgaacatggtcaacaaacgcgccgtggattttaccccggcagaatgcggggactccgaatgggccgtgggccgcgtctctctgggcctgcgaatggcaatgccgcgggacttctgcgcgattattcacgcccccgcggtatccggccccgggccccacgtgatgctcggtctcgtcgactcgggctaccgcggaaccgtcctggccgtggtcgtagccccgaacgggacgcgcgggtttgcccccggggccctccgggtcgacgtgacgtttctggacatccgggccacccccccgaccctcaccgagccgagctccctgcaccggtttccgcagttggcgccgtccccgctggcagggttacgagaagatccttggttggacggggcgctcgcgaccgccgggggggcggtggccctgccggccagacggcgcgggggatcgctggtctacgcgggcgagctaacgcaggtgaccaccgagcacggcgactgcgtgcacgaggcgcccgcctttctgccaaagcgcgaggaggacgcaggctttgacattctcatccaccgagccgtgaccgtcccggccaacggcgccacggtcatacagccgtccctccgcgtattgcgcgcggccgacggaccagaggcctgctatgtgctggggcggtcgtcgctcaatgccaggggcctcctggtcatgcctacgcgctggccctccgggcacgcctgtgcgtttgttgtatgtaacctgaccggagtcccggtgaccctacaagccgggtccaaggtcgcccagctgctcgtcgcggggacccacgccctcccctggatcccccccgacaacatccacgaggacggcgcattccgggcctaccccagaggggttccggacgcgaccgccaccccccgagacccgccgattttggtgtttacgaacgagtttgacgcggacgcccccccaagcaagcggggggccggggggtttggctccactggcatctagaccgcgcctcgcgtcgggccagatggggccccggtcaataaagagctctgtttcgcatatgccctggtgttggcggttttttttgttgtctgtctgcccggcgctcggttgtccgttctgtcgtcgctatcacatacgcacaaacacacgggtagagtggaaccgaaaccggtcgacgtttattcaccacacagaaacacaagctaagcgagaaggaggggggcctcggtcgacgaggcctggcgtttgggggcggacgtgcgatgacgtgggtccggtgtagggtccgcggggggcacgggcccggggcgaacgggggatctgtcgccggcgtgggtgactgggaccgacgcaacctccggggcttgtgccctcgtaggcccggggggggcctcggtcgctccaagccccgcggtgcgggtccctccggccagagccgaggtggagagaccaagggcccgctccgcgatcgccacgtcctccatgaccacgtcgctctcggccatgctccgaatggcctgggagacgagcacgtccgccgacttgtccgcggcccccaccgacatgtacatctgcaggatggtggccatgcacgtgtccgccaggcggcgcatcttgtcccgatgcgccgcaacggccccgtcgatggtggagccctcgagtcccgggtggtggcgcgccagcctctcgaggttgaccatgcaggcgtggtatgtgcgggccagggcgcgcgccttcacgaggcgccgggtgtcgtccagcgactctagggcgtcgtcgagcgtgatgggggcgggcaaaagcgcattgaccaccgccagggcctcctgcagccgcggctccgcctccgagggcggagccgcggcccgaatcatctcatattgttgttcctcggggcgcgttccccaaccgcacagcaccccgagcagggacgccatcccggaacacgcgcgcggctctgcgccggctttcccccaccccaccccctccgggttcgcaggggcgatggggacggaagactgcgatcacgaagggcggtcggttgcggctcccgtggaggttacggcgctgtatgcgaccgacgggtgcgttatcacctcctcgctcgccctcctcacaaactgcctgctgggggccgagccgttgtatatattcagctacgacgcgtaccggtccgatgcgcccaatggccccacgggcgcgcccaccgaacaggagaggttcgaggggagccgggcgctctaccgggatgcgggggggctaaatggcgattcatttcgggtgaccttttgtttattggggacggaagtgggcgtgacccaccacccgaaagggcgcacccggcccatgtttgtgtgccgcttcgagcgagcggacgacgtcgccgtgctccaagacgccctgggccgcgggaccccattgctcccggcccacgtcacagcaactctggacttggaggcgacgtttgcgctccacgctaacatcatcatggctctcaccgtggccatcgtccacaacgcccccgcccgcatcggcagcggcagcaccgcccccctgtatgagcccggcgaatcgatgcgctcggtcgtcgggcgcatgtccctggggcagcgcggcctcaccacgctgttcgtgcaccacgaggcgcgcgtgctggcggcgtaccgccgggcgtattatgggagcgcccaaagccccttttggtttctgagcaaattcggcccggacgaaaagagcctggtgctggccgctaggtactacctactccaggctccgcgcttggggggcgccggagccacgtacgatctgcaggccgtgaaagacatctgcgcgacctacgcaatcccccacgacccacgccccgacaccctcagtgccgcgtccttgacctcgttcgccgccatcactcggttctgttgcacgagccagtactcccgcggggccgcggccgctgggtttccgctgtatgtggagcgccgcatcgccgccgacgtacgcgagaccggcgcgctggagaagttcatcgcccacgatcgcagctgcctgcgcgtgtccgaccgggaattcattacgtacatctacctggcccactttgagtgcttcagccccccgcgcctggccacgcatctccgggccgtgaccacccacgaccccagccccgcggccagcacggagcagccctcgcccctgggtcgggaggcggtggaacagttcttccggcacgtgcgcgcccagctgaacatccgcgagtacgtaaagcaaaacgtcacccccagggaaaccgccctggcgggagacgcggccgccgcctacctgcgcgcgcgcacgtatgccccggcggccctcacgcccgcccccgcgtactgcggggtcgcagactcgtccaccaaaatgatgggacgtctggcggaagcagaaaggctcctagtcccccacggctggcccgcgttcgcaccaacaacccccggggacgacgcggggggcggcactgccgccccccagacctgcggaatcgtcaagcgcctcctcaagctggccgccacggagcagcagggcacgacgcccccggcgatcgcggctctcatgcaggacgcgtcggtccaaacccccctgcccgtgtacaggattaccatgtccccgaccggccaggcgtttgccgcggcggcgcgggacgactgggcccgcgtgacgcgggacgcgcgcccgccggaagcgaccgtggtcgcggacgcggcggcggcgcccgagcccggcgcgctcggccggcggctcacgcgccgcatttgcgcccggggccccgcgctccccccgggcggcctggccgtcgggggccagatgtacgtgaaccgcaacgagatcttcaacgccgcgctggccgttacgaacatcatcctggatctggacatcgccctgaaggagcccgtcccctttccccggctccacgaggccctgggtcactttaggcgcggggcgctggcggcggttcagctgttgtttcccgcggcccgcgtagaccccgacgcctatccctgttattttttcaaaagcgcctgtcggccccgcgcgccgcccgtctgtgcgggcgacgggccctcggccggtggcgacgacggcgacggggactggttccccgacgccggtggtcccggcgacgaggagtgggaggaggacacggaccccatggacacgacccacggccccctcccggacgacgaggccgcgtacctcgacctgctacacgaacagataccagcggcgacgcccagcgaaccggactccgtcgtgtgttcctgcgccgacaagatcgggctgcgcgtgtgcctaccggtccccgccccgtacgttgtgcacggctccctgacgatgcgtggggtggcgagggtgatccagcaggcggtgctgttggaccgcgacttcgtggaggccgtagggagccacgtaaagaactttttgctgatcgatacgggcgtgtacgcccacggccacagcctgcgcttgccgtatttcgccaagatcggccccgacggctccgcgtgcggccggttattgcccgtcttcgtgatcccccccgcgtgcgaggacgttccggcgttcgtcgccgcgcacgccgacccgcggcgcttccactttcacgccccgcccatgttttccgcggccccgcgggagatccgcgtcctccacagcctgggcggggactatgtcagctttttcgagaagaaggcgtcgcgcaacgccctggagcactttgggcgacgcgagaccctgacggaggttctgggccgctacgatgtgcggcccgacgccggggagaccgtggaggggttcgcgtcagaactgctggggcgaatagtcgcgtgcatcgaggctcactttcccgagcacgcgcgggaatatcaggccgtgtccgttcgccgggccgtcattaaggacgactgggtcctgctgcagctgatccccggccgcggcgccctgaaccaaagcctctcgtgtctgcgcttcaagcacggcagggcaagtcgcgcgacggcccggacctttctcgcgctgagcgtcgggaccaacaaccgcctatgcgcgtccctgtgtcagcagtgctttgccactaaatgcgataacaaccgcctgcacacgctgtttaccgtcgatgcgggcacgccatgctcgcggtccgctccctccagcacctcacgaccgtcatcttcataacggcctacggcctcgtgctcgcgtggtacatcgtctttggtgccagtccgctccaccgatgtatttacgcggtgcgccccgccggggcgcacaacgataccgccctcgtgtggatgaagataaaccagacgctgttgtttctgggcccgccgaccgccccccccggcggggcatggaccccccacgcccgcgtctgctacgccaatatcatcgaaggtcgggccgtgtccctcccggccatccccggcgccatgagccgccgggtcatgaacgtgcacgaggccgtaaactgcttggaggccctctgggacacccagatgcgcctggtggtcgtcggttggtttctgtatctagcgttcgtcgcccttcaccaacgacgatgcatgttcggcgtcgtgagtcccgcgcacagcatggtggccccggcgacctatcttttgaactacgccggccgcatagtgtcgagcgtgttcttgcaatacccctacacgaaaatcacccgcctcctctgcgagctatccgttcaacgccagaccctggtgcagctgttcgaggcggatccggtcaccttcttgtaccaccgcccggccgttggcgtcatcgtgggctgcgagctgctgctccgcttcgtggccctcggtctcatcgtcggcaccgctctcatctcccggggcgcctgcgcgatcacacaccccctgtttctaacaatcaccacctggtgtttcgtgtccatcatcgccctgacggagctgtatttcatcctgcggcggggctcggcccccaaaaacgcggaaccagcggcccccagggggcgctccaaagggtggtcgggcgtctgcgggcgctgctgttccatcatcctctccggtatcgccgtgcgcctgtgctatatcgccgtcgtggccggggtggtgctcgtggcgcttcgctacgaacaggagattcagcggcgcctgtttgatctgtgacgtaacgcctcttccgttggaagaggcggacccagtcgcccatgcaaattaaatacacgacccgcctcgggcctacgcaccctcgcacgtcgcatgcaaattaaaatcgtgcacagagccgatccggcctcgggtctgcttgcccctcccccggcccagcacaggcaggctcgtccgacttccgcatacaccccaccctaccgcgtgcttccgcacccccgcctacgcgtgtacgcgaaggcggacccagacctgccgtatgctaattaaatacataaaacccaccctcggtgtccgattggtttctggggacggcgggggcgggggcggtgacgcccgacggggagggacaaggaggagtttcggaaagccggccccggtcgtgcgggtataagggcagccaccggcccactgggcgctgtgtgctgccgtgtgccgaccccggttgcgcgtcggtgccgctcctcgattcggacccggccactctcttccgacacgcgccccctcggaggacacccgccatcccagccccggcgacctacaacatggctaccgacattgatatgctaatcgacctaggattggacctgtccgacagcgagctcgaggaggacgctctggagcgggacgaggagggccgccgcgacgaccccgagtccgacagcagcggggagtgttcctcgtcggacgaggacatggaagacccctgcggagacggaggggcggaggccatcgacgcggcgattcccaaaggtcccccggcccgccccgaggacgccggcacccccgaagcctcgacgcctcgcccggcagcgcggcggggagccgacgatccgccacccgcgaccaccggcgtgtggtcgcgcctcgggaccaggcggtcggcttccccccgggaaccgcacggggggaaggtggcccgcatccaacccccgtcgaccaaggcaccgcatccccgaggcgggcggcgaggtcgccgccggggccggggtcgatacggccccggcggcgccgactccacaccaaacccccgccggcgcgtctccagaaacgcccacaaccaagggggtcgccaccccgcgtcggcgcggacggacggccccggcgccacccacggcgaggcgcggcgcggaggggagcagctcgacgtctccgggggcccgcggccacgaggcacgcgccaggccccccctccgctgatggcgctgtccctgacccccccgcacgcggacggccgcgccccggtcccggagcgaaaggcgccctctgccgacaccatcgaccccgccgttcgggcggttctgcgatccatatccgagcgcgcggcggtcgagcgcatcagcgaaagctttggacgcagtgccctggtcatgcaagacccctttggcgggatgccgtttcccgccgcgaacagcccctgggctcccgtgctggccacccaagcgggggggtttgacgccgagacccgtcgggtttcctgggaaaccctggtcgctcacggcccgagcctctaccgcacattcgcagccaacccgcgggccgcgtcgacagccaaggccatgcgcgactgcgtgctgcgccaggaaaatctcatcgaggccctggcgtccgcggatgagacgctggcgtggtgcaagatgtgcattcaccacaatctgccgctccgcccccaggaccctatcatcggaacggcggccgccgtgctggaaaacctcgccacgcgcctgcgcccctttctgcagtgctacctgaaggcccgaggcctgtgcgggctggacgacctgtgctcgcggcgacgcctgtcggacattaaggatattgcctcctttgtgttggtcatcctggcccgcctcgccaaccgcgtcgagcgcggcgtgtcggagatcgactacacgaccgtgggggttggggccggcgagacgatgcacttttacatcccgggggcctgcatggcgggtctcattgaaatactggacacgcaccgccaggagtgttccagtcgcgtgtgcgagctgacggccagtcacactatcgcccccttatatgtgcacggcaaatacttctactgcaactccctattttaggcaagaataaacatattgacgtcaacccaagtggttccgtgtgatgttcttggcgcgcgcggcgggtggggcggagactccggggcgatgccggcgtgcgcgtgggaggagggcgatgacccaccggataaatgtggggccccggcccggcccgcttcatagcgcgtccaggaactcacggcagacgcgtattcaccgacccccccctcgcaacatgacaacgacgcccctctcgaacctgtttttacgggccccggacatcacccacgtcgcccccccgtactgtctgaatgccacgtggcaggccgaaaacgccctgcacacgaccaaaacggaccccgcgtgcctggccgcgcggagttatttagtccgcgcctcctgctcgaccagcggccccatccactgttttttctttgcggtgtacaaggactcgcagcactcccttccgctggttaccgagctccgcaacttcgcggacctggtcaaccacccgcccgtcttgcgcgaactagaggataagcgtggggggcggctgcggtgcacgggcccattcagctgcggaaccatcaaggacgtctccggtgcatcccccgcgggggaatacacgataaacggtatcgtgtaccactgtcactgtcggtatccgttctccaaaacctgctggctcggggcatccgcggccctacaacaccttcgctctataagctcaagcggcacggccgctcgcgcggcagaacagcgacgccacaaaatcaaaatcaaaatcaaggtataacccacccccttccctccgagtccgtatgcaacctcattaataaagagtgagaaccaaccaaaacagacgcggtgtgagtttgtgggttataggaacccggtaaataccacgcgacgaaccagcatgtgtgttaacgcaacttttattcgttgtatcgcgggaggggggaagcttaccgccaaaggaaggccaagatgataacgacgaccaccgcgaccaccccaaaaaccgcatgacgacacgtcccgccacaccaccctggggcttggggcgtgtcggagctcgacgcacagcgggccgcgcgttgggcccggtacagctctcgcgaattgacaagcgggggtcgccacgtgcgcgagctttgcacgcggggttggtcggccggccccacggacccgcccggtggctcggtcggacatgcggccatgaccatggcgtaggtgggggggcgatccgaggtcgcctctgcgtaagtagggaggcccgacgggaggtcgcctcccacgccagggtgggccccaatcatagtttccggtagaaacaggggggtctccacaaacaacccccctgggccaaagctccggcgccgcgcccgtcgttcggcgcggcgcctggcgcgccgagcggcccgccaggcggcgcggcgcgagcggccacgctcacacacctcgccgtcaccggaagaagccggtgaaacaagcccaaccggcgacgtccctgcagagtacggtggaggcgagtccgtgggggtgtcgatatcaataacgacaaactggcccgcgctcgcgccggccacactctcgtatgggggcggggcgtcaatcacgctatcatctccgtcatccctgcatgcgtgggcatgcccagcccccaacgccatggtggggattcgcggctcagaagcctgcatgtcgtgtggtcggtcgtagtccaacgtgcctcccccacccaccacacagccggtccccacgccgaccactagaccgcagacgtcgcccaaccgaggtccccgtgcacagaccgcgccttttatagccccaggggttgctaattaacgcacgcatgcagacgcaatttattttgctcccccgcgtcctcccctcccctgcgcacacgtgataggtcttgggaacccgaggggcgacgcggggaaagcgcgcccccgcccggccgccgcgcgcccccgcccggccgccgcgcgcccccgcccggccgccgcgcgcccccgcccggccgccgcgcgcccccgcccggccgccgcgcgcccccgcccggccgccgcgcgcccccgcccggccgcccgcgtcgcgccggcgccccctcccggcgcttccggggtctttccttccttccccgccgcgaccccggccccgccccaccgccccgcccggcaggggggccccggcgccgcgcagaacacacagacgaacacacggtggcgatcttttctttacttcggcggaccagcgagccccggccccggcccgcgccccgccgccacacccacggcaccccccccccgccgcccaccccggggtccacacaggagcgcgcgggcggcagaaacgcgggcgcggcggcggtcggggtgggagtggtggtgggggacacgaaaacacacccacgacactctccccccaccccgaccgccgccgcgccccaccggcgggatcgcggcgagacgcagccgggcccccccccaccacccgcccacccacctaccccgcgcccgcagcctccggcagcacgccgaccaccgccgccaccccccaaacagccaaggcgcggtggggggcgtggtggtgaacgatggggggaacacgggggggaggggtccggggcgaggcgggcgggcgaaggaagggggggtggtggcggcggcggtggaaagcggaaaaacggaggatggaagggcagaagatggggagtcccgatcctcctcctgcatcccctcgccttccattctccggccctccgcgagtcccgacgccccccccccgccgcccgacgaaggagacccaagcaccgcagccggagaggccgagcggggagtgggcggccgggcgggaggatggcggagagagagagagagagagagagagggggggggggggagagggaaagcaacgggaaagagaggcgcgcggaaaagcagcaagaggggggacggggcgagccgggcagagtgcggagcccccggagcccgcggccgcagccgagcagcgccgcgggctccggggccgggccgggccggcaacgccccgcgccggccgcggcggagagaacccctgtgtcattgtttacgtggccgcgggccagcagacgggccgcgggccagcagacgggccgcggcgccagcggcccacgcctcccgccgcattaggcccccgcgggcatccggcggccggccccacgcccttccattaaacactcccacgttgggggggggcgcgccagctgagtgctctgcggttgcgggcgccgtgcccggagatccattaagccgccggagagcccgagccccgcccgcgtgttgctgtgggcatttctgctgcgtcatccctgtctttataaaaccgggggcgcggcagcaacgaacgcaggggcccgccgccgatcgagagggactccggagaaggaaggctgctccgcgcaccggcgcgcccttctcctctcccctccctacctccccctctcttcccccttttttcccccgcctcccgtcttcttccgcgcctccgagggtccgcctctgcctcggggacccccgggcgggccggggcttggccgccgaggtgcgccccggccggaggggcccccgcacctcggcggccgccccctccggcgccgcgcgttcgcgaaaggcgcgaaaggggcccccggaggcttttttcgattcccggccgggggtcccgggtagccgcccggcgccgggcggaaggcgtcccccgcccggcggtccggcccgggcccccggcggagcgcgggggccccggggccccgggccgcgccggcggcgtttccgcgttccgtttcttctccctcccggccgccccgctcccgggcccgaccctcgccccttcccttctcctcgtcttcccccgtcccgccgcgccccttccctcttccttctctctctctgtctcgctctcctcacatttcccccccccccccgccgccgccgccctctgcccgcgtcccaccgagacgccgcgccgcgtgagccgtccgccgggggacccaggctccggggggggggggcgcctgcgtgtgtctcgtgtgagagagcgcgcccctcgaacgccgcgcgttctcgcaggtaggtttagggtcgtacaggtgagcttctgctgaggcggcgggagagggggggggggcgggcggaagagagaagagagcaggggttgggggagaactgttcttcctccccctttcaagaaacacgaggcgggggtcccagaaagggcaggcaggtcagccgcaccgcccgcgagccaacccgtatcctttttttctaggtgtttttgtttttgtttctgtttttgtttgttttgttattattttcgcggatccggcgtgttcggatccaccccccctttctccttcctcttcccttccacccacccccgtttcccccccccgtggtgtcgtccgggggcgtcgttcccagggggggcaggcgcgggtcgggcccatacgcccaccgcccccacgcgccggtcacccccccccaacaaccccaaaggcgcgtgcccagccacagccgtgggtgtggcgcccgtccccttcctctaccgcgtgggcgcgggcgggggggtggtggtagtggtggcggaaggaaacgggccgggggccggggccgctagggaaaggtaggcacgcgcgcggtgtgtcgacttgcatgccccgcaaaacgcgtcgtgtcgtgttgtgtcgtggtgggccgtgttgtggtgggccgtgtggtgtggtgtggtgttgcgaacgcgcgagccccctcgccccgatgggagtctccccgcagccagggtaaggaggggcgggcgtggcgggcaggtgtgcgggcggggtggggtgagtgcggttgcatgcctcgggtctcctcttcctgctcctcctcctttctcccagccagggtgaggaggggcgggcgtggcgggcaggtgtgcgggcggggtgggcgccggggcgggggtgggcacgggcgtaagtgcgggtgcatgcctcgggtcttctcttctccctcctccttcctcccacccgtccccgggggcagagggcgtgcatgcgttgtgattcaaccgccctcgcccccgccccactttccccccctctctatcaaagttccctggcccctggcttcgcgccggtggtgcggctgaccccccccctcctccctccccgagccaggcgccctcccactcctgcccaccacccccagggtctggccggccagacgtgcgtgctctgcacgatcgggcccccctccctgtcaacacggacacactctttttttacccgccagccagcccgcccacccaccaagacagggagccagaacgcaggccgggccccggctctgttctatcataaagaccaacaggcctcgggggtgggggcggcttctcgtgcccgccccccctcctcctcctccctttccccccccccatccccggcccccctgcgcgggggagctgcatcaaaggccaacaacaaagtgtgtcaaaagcatcacaaaactttattgtaaaatttttataaatataaagttttttttcctcaagttttcaacaaggccagaaagtccataacaaaatgctggtgtgtgttgctgttcggggccgtgtccgtccccccccactcccacccccacttcctgtctcctccccgtctttcccccccacctccccctgcccccgaggcgcctcggccggtggtccggtggggggcggcttccctttgggcagcaagccgagtgttagctccccctactccccgtggcccgcgggggcgtcgccggccggcgcgggcgcgccctgctcccgagaccacgggtggcgcgaccggaggccgtggaagtccagcgcgcccaccagggtgccctggtcaaagagcatgttgcccaccggggtcatccagaggctgttccactccgacgcggggggcgtcgggtagtcggggggcctcacgcagttgcgcgcgtgctcggggagcagggtgcggcggctccacgcgggggccgcggcccgcagcaggtccgccacgttccccgtctggtccacgaggaccacgtaggcccctatgtggcccgtctccatgtccaggacgggcaggcagtcccccgtgaccgtcttgttcacgtaaggcgccagggccacgacgctcgagacccccgcgatgggcaggtagcgcgtgaggccgggcgccgggtcgcgggccccgggctcggggccgccctccgcgtggcgcgtcttcctggcacacttcctcggcccccgcggcgcagcagcgcgggggccgagggaggtttctcgtctctccccagcgccggacgcggacgcgacgctcccaccagccccgcccgcagaggaagaggcggaggaggaggaggaggaagaggaggcggcggaggaggaagaggcggcggaggaggaagaggaggcggcggaggaggaagaggaggcggcggaggaggaagaggaggcggcggaggaggaagaggaggcggcggcggcgaccgcggcctgggacgacggagacgccgacgggggcgcggcgcccgcggacgccggggcgagcggcccgtggccgcggtcgcccgagtccgagtccggggcccggcgcggcgccgccctcttggcccccaccccctggggggcgaggggcgagcgcggggcggcggaggaagaggcggaggacgaggccgcagggcccgagtccgacccgcgcctcttccgggggcgggccgccgccccctccgcggcgtggggggcggcaccgggggtgttggtgccgcgggggaccccgggtcctccctccgcgcccggccctcccgacccgcgcgcgtcggtcgcgcctgcccggcccagactctgtgcttgggtgtcggtctgagcctgggtcatgcgcgaccggggcgcgcggtgcgcgtccaccggcacggcgggcggcgcgggcccggccgcgtccgcgctcgcagacaccacgggggcggcggcggcgcggggcggactccggacgcgcggggcgacggccgcgcgggggcgcgccgcgcgccccgacgactgtggcagacctccccccccggggcccgaggacacctgcgcggaggaggaggagaaaaaggagagcggcccggggcccgcggggcggcgcggagacggcgggggagagtcgctgatgactatggggggctcctgggccgcgcggggctgtcccgcggggggcgtcctgccctccgccgccgcggcgtcttcgcccacccgccgcgcctgcgcgcgccccccgccggccgcagggggaagagaggccactctcggcacgacggccgcgacggcagggccgcccccagacccagatcccacccccgcccgcaacggggcgccgccgctgctgctgctccgcggggcgccagggggcgccggtcgggtcgcggcgggctgggaggttccgcgggtcgcccccgcaccgccgcccccgcgccggggcgctcttcggggggcgggcgggacgtagtccactgcagagggagacagagacgggagcccccggttagtgcccgacccccgcccgacccccgcccgacccccgcccgacccccgcccgacccccgcccgacccccgcccgacccccgcccgacccccgcccgacccccgcccgacccccgcccgacccccgcccgacccccgcccgccctcaccgtcggccaggtcatcgtcctcgtcgtccgtgccgggccacgggggggtgggcgacagggcgcggaccgtgtgtccccccagcgacagggagcgcggggccgtccgctggttgcccgtccagataaagtccacggccgtgccggcccgcacggccgcctcggcctccacgcgggtccgggggtcgttcactatcgggatggtgctgaacgacccgctggcggtcacgcccactatcaggtacgccaccggggtgttgcacaggggacacgtgttgcgcaacggaatccaggtcttcatgcacgggatgcagaaggggtgcaggcagggaaaactctggcagcgcaggggcggggcgatctcgtccgtgcacacggcgcacacgtcgcccccccctcccgcttccgcttcctcctcacccacgggcccacccccgcaggatccctgcgcgtcggcgggcgtggggctgccctggcgctcggccgggggccgggccgggggcgtggccgcgtccatcaggcccgcctcgaacatctccgtgtccgtgctgcccgcctcggaggtggagtcgcggtgaaggtcgtcgtcagagattcccacctcggtctcctcctccgagtcgctgctggcgagccactgcatgtcgttgagcatcccccaggcgtgcggggcggcgggctgcttgacaaagcaacgggggggatttagagggcgcggggcgtgaggcgggacccccgcgccgtgtcccccgtgtccctccctcaccccggccccccgcccgctgctttttgttcggaagggggggagaaaggggtccgtaaccaaaggtggtctgcgtcctttggattccgacccctcgtctccccccctgtcccccgctctcgggctcctccctgcctccctcgcccccccagagggtcggggggcggcgcacggcccacgggggtcccccgaccgcttaagcgggccgggggtcggccccgtcaagcgtccccgcccccgagcccaccgcccgcgaccacccccaacccgcagccgggtggtccggggaaaagggggggcctgagacccgggggtcgccctctcaccgtgccgggggtctgccgcggcggccgctcggggccggggtccgcccgggagctcgtgccgggccggggttccatgagccggggtagggtagactcgagacggcggcccgcggtctctctcttgccgggttttagtctctgtctctccgggtctcctcctcccgccgggccgccgctccgtcgctcgcagtgccggggtgcgaatgcggcccgaccgtcacacggggctgccttatacccggcgcctatccactcccccaaaggggcggcatttacgattcccccaatagccgcgcgccccggcgggggcggagggagggaatccccccctctcggggcggccccgtccccggggaccaaccgggtgtactccaagaaccccattagcatgcgccgccccccgccgacgcagatgggagtccccccggcgccccgccggcgcggccctgagtggtgcccgcccccggggagaaattcattagcatactaggaagcccaggggaccaataggggccgatcagcccacccacccggcggcgcgcgaggctctgcgtgttctgccaagaaagtaatcagcataacccggaaccccgagggagtaattacgcggggagcgaggggccgtccgaacgtttttaattaccataagcgggaatggcggcccgttaaaagctgctaattaccgcgagcgggaacgccggcccattaaaagttgctaattaccatgcgcggggatggcggccgggaccgcctattaaaagtttctaattaccataccgggaagccggtctagaggatccccgggtaccgagctcgaattcatcgatgatcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggatccatgaacttcggcctgagcctgatcttcctggtgctgatcctgaagggcgtgcagtgcgaggtgcagctggtggagagcggcggcggcctggtgcagcccggcggcagcctgcggctgagctgcgccgccagcggcttcaccttcagcgacagctggatccactgggtgcggcaggcccccggcaagggcctggagtgggtggcctggatcagcccctacggcggcagcacctactacgccgacagcgtgaagggccggttcaccatcagcgccgacaccagcaagaacaccgcctacctgcagatgaacagcctgcgggccgaggacaccgccgtgtactactgcgcccggcggcactggcccggcggcttcgactactggggccagggcaccctggtgaccgtgagcgccgccggtggcggtggctcgggcggtggtgggtcgggtggcggcggatctgacatccagatgacccagagccccagcagcctgagcgccagcgtgggcgaccgggtgaccatcacctgccgggccagccaggacgtgagcaccgccgtggcctggtaccagcagaagcccggcaaggcccccaagctgctgatctacagcgccagcttcctgtacagcggcgtgcccagccggttcagcggcagcggcagcggcaccgacttcaccctgaccatcagcagcctgcagcccgaggacttcgccacctactactgccagcagtacctgtaccaccccgccaccttcggccagggcaccaaggtggagatcaagcggaccggtggtgggtcggatatcaaactgcagcagtcaggggctgaactggcaagacctggggcctcagtgaagatgtcctgcaagacttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcagtcgaaggtggaagtggaggttctggtggaagtggaggttcaggtggagtcgacgacattcagctgacccagtctccagcaatcatgtctgcatctccaggggagaaggtcaccatgacctgcagagccagttcaagtgtaagttacatgaactggtaccagcagaagtcaggcacctcccccaaaagatggatttatgacacatccaaagtggcttctggagtcccttatcgcttcagtggcagtgggtctgggacctcatactctctcacaatcagcagcatggaggctgaagatgctgccacttattactgccaacagtggagtagtaacccgctcacgttcggtgctgggaccaagctggagctgaaacatcatcaccatcatcattagctcgagctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccaggttatccgtgtaaccgccagtccgtgcttgcctagcgaactcacccgtcccggctggcgtgcgcagcccgggccgtgttgcgggccctcttaaggggcggcggcaggacggggactcccgccccgcctcttttcccccggggagtcaacccccggggggggtgttttttgggggggggcgcgaaggcgggcggcggcggcgggcgggcggcagggcagccccgcgcgcccccttccccgtccctcccccggagccggccgctcccccgcgggcgccgcccctccccccgcgcgccgcggggctgccttcccgcgggcgcccccgcgcggcttttttcccgcgcccgcccccgcgcggcaagacggggactagcaggctgtgccgcagaccaccacacactcccaagctccccgcccccccgaagacgccagtcgcaccaccgctcgccctcgcagaccagacagttgcaccaagcacccgcccgcccgcacacggttccccgccaccccctccctcccctccatcccgccgagctcgcggcagcccctcccccccgcgcgccacggggctgcggtcccgcggccgcctcccccgcggccgcctcccccgcgccccgccccgggggcttcccccgcccctccccccgcgcccgcggccccgagctcgcagcagcccctccctcccgcgccccgtgccttccctcccgctcctgcgggggggctcgggccacctgaccttcgtaacctgcactcaggtcagagccccagaccccccgcgggcgcgggagacgtgccgcccacccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgaataaaccacacaaggcggtacgttttcgtctgtctcgttctttatttctcacacacgcgcgcggccatcgccgcgtctgtcttaaaggcgcacagacgcccgattccttccccctctccccatctcccccctcccccgctcccggaagtttcccccccgtcactccccaaacagtccgtcgtcgtcgtcctccagctccgcgtccatgtccacgggctcgcgcctcggcggcgtggccagccccgcggcggtccccaccacctccacgccgccgcccgccgcggccagcaccgtccccgcgcggcccgcggccgacgcccagcgtatctgcgggggcgggcccgcgtccgcgtcgtcgcgcagcaccagcgggggcgcgtcgccgtcgggctcgagcagcgcccgcgcgcagaactcccgccgcggcccgcgcagctccgccgggccgccgcgcacggcgtcgcgccccagcgccacgtagacgggccgcagcggcgcgcccaggccccagcgcgcgcaggcgcggtgcgagtgcgcctcgtcctcgcagaagtccggcgcgccgggcgccatggcgtcgcccgcgcccgaggcggcggcccggccgtccagcgccgggagcacggcgcggcggtactcgcgcggggacatgggcaccagcgtgtcggggccgaagcgcgtgcgcacgcggtaccgcacgttggccccgcggcagaggcgcagcggcggcgcgtcggggtacaggcgcgcgtgcgcggcctccacgcgcgcgaagacccccggcccgaacacgcggccggaggccagcacggtgcggcgcaggtcccgcgccgccggccagcgcacggcgcactgcacggcgggcagcacctcgcaggccaggtaggcgtgctgccgcgagaccacgggcccgtcggcgggccagtccgcggcgcgcacggcgttgacgacgatgaggcggcggtcgcaggcgccggccagcagccccaggaactccacggcgccggcgaaggccaggtcccgcgtggacagcagcagcacgccctgcgcgcccagcgccgagacgtcgggggcgccggtccagttgcccgcccaggcggccgtggcgggcccgcagagccggttgcccagggccgccagcaggcaggacagcccgccgcgctcggcggaccactccggggggggcccgcccccggcgcggcccgcggccaggtcctcgcccggcagcggcgagtagaggatcaccacgcgcacgtcctccgggtcgggcacctggcgcatccaggccgccgcgcggcgcagcgggcccgaggcgcgcagcgggccgaaggcggcgggcgcgccgccggggggcggggcggcgcagcgcgcggccagcgaggccagcgcgcgcgggtcgaacatgagggccgggcgccacggcgcggggaagagcgggtggtccgtgagctcggccacggcccgcggggcgcagtaggcctccagggcggcggccgagggcgccggcgtgtggctgggccccggcggctggcggcgccagccgccctgcgggtcggggccctcggcgggccggcgggtcagcgccgcggggcgcggcggccgcggcggcggcgtcggcggggcggggggcgcggcccccgcgggaggggcggccgcggggcggggggcgtccgcgcggctcttcttcggggggcgcggggcgccgcccggcggcgccctggccggggcggggctcttgcgcttgcgcgcctcccgcggcgcggaggcgggcgcggcgagcgagtcggccgcggcgacggtgtcggccagcagggggcgcaggctctggttctggaagagcaggtccgcggcggcggcggcggcggagctcagcaggcgcgggctccgcggcagcgccgggcccagggccccggcgaccaggctcacggcgcgcacggcggccacggcggcctcgctgccgccggccacgcgcaggtccccgcgcaggcgcatcagcaccagcgcgtcgcgcacgaaccgcagctcgcgcagccaggcgcgcaggcggggcgcgtcggcgtgcggcggggcggccgcgcccgcgggccccgggcgcgggggcgcggcgggccgggctccggccagccccggcacggccgccaggtcgccgtcgaagccctccgccagcgcctccaggatcccgcggcaggcggccaggcactccacggccacgcggcccgcctccgcgcgccggccgccgccaccaccgccggcgccgtcgtcgtcgtcgtcgtcgtcggccccggccggcgcggaggcgggcgcggcgctcaggcgccccagggcggcgagcacccccgcggcgccgtagccggcgggcaccgcgcgctcgtcggccggcgacgccgccgccgacggcaacggggcggcggcggcggcgggcttcccgcgggcgtcgtcgccgtcgtggcggttggcgtcgccgccgtcgtcgggggttcgcgccccggtcagcgccgcgttctcgcgcgccagcaggggcgcgtaggcgcggcgcaggctggtcagcaggaagcccttctgcgcgcggtcgtagcggcggctcatggccacggcggccgccacgtgcgccaggccccagccgaagcggcccgccgccatggcgtaccccaggtggggcacggcccgcgccacgctgccggagatgaaggagctgctgttgcgcgccgcgcccgagatccggaagcaggcctggtccagcgccacgtccccgggcgccacgcgcgggttctggagccaccccatcgcctccgcgtccggcgtgtacagcagccgcgtgatcagggcgtactgctgcgccgcgtcgcccagctcgggcgcccacacgggcgccggggcgcccgaggcctcgaaccgggcccgcgcctcctccgcctcgggcgccccccagaggccggggcggctgtcgcccagcccgccgtacagcacgcgccccgggggcggggggccggccccgggccacggctccccgctgacgtacccgtcgcggtagcgcgcgtagaaggcgccggaggccgcgtcggcgtccagctcgacccgccggggccgcccggccgtgaagcggcccgtggcgtcgcggccggccaccgccgcgcgggcccggcggcgctccaggcggcccgcggtcgccgcgggggtccgggccggggcgggctcggccctgggcgggctcggccggggcgccgcccccggggccctcgcgggcacccccgcctcctcgtcgtccgcgccgagggtcccgcccgcggcgtggtctgcggcgctggcgggggcgcgggcggcgtcgtcgtcgtcgtcgtcgtcagacgaggaggcggatgcagacgaggaggaggaggcggaggaggaggcggaggacgccgacgacgaggatccggattttgatgagtcagaggcggccgagcgccggcggggggcgcgccggcggcggtggtggtggtggtggtggtgtcggcggggcgccgggggtcgcggcgacaggctggccatggggtccgggtacgccccgcggaccgcggacgtcgtctccggtccgcggacccagcggcccgcgtcgcggtcgtcgtcatcgtcgtcgtcgtcgtcgtcgtcgttctcctcgccataatcggcgcgcatggagggggtccgcggcggagaaggcgagcgggccgcttcttcttccgcgccgtcgcgctccggggggggcgacgggatcgtgcgaacggcctcgtccaccatcgaggccagcagggccagctgccgcggcgagacgacgccgtccgcggcaggctcgtcgacggcctccccggacgccggggccgcctcgtcggcatcggcatcggcggcggcgtcgtcggcctcgtcttcgttctcctccggcccaccgtgccacccgaacccgggccgcgcggcggggcgacggtccgggttcggggtgggcggcggtccgtcggctggatccggagatccggggccgccggtcgtctccgccgcggcccggagacgtcccccgtcctcgtccgccatcgcgacctcggccccgcggccctgcgtcgtcgtcgtcgtcttcttcttcttccgctgctccgccgacatcgcctccgaccggggtgtgcgggggggggtcttcttcttcttcttcaggggcggcagtgggggggggtggttggcagtctctctcccccccgtgcggtgcgtgcgtgtgcctgtgtcttttcgcctctccgcgccgatcgggtagatcctggcggccgcgtcggtagccgcgctccgtgtggacgatcgccccgtcgcctggctgatatagtcctcggggcgcgcggggcggggggaaaggaggaggacgcggaggaggagcgatcgacgccgccgcgccccggctcgccggggttccgcccccaggtggaaccgcattatgcgcggccccgccccgacgcccgcgcgtccgcgtccgtggcggcggcccgttggtcgcgccgccgccggctccgcccgcgcggcatctcattagcgcccggcgcgggcggcttccgcttccgcccgcgatgctaatgagaccctcgtcgcgggcgggctcgctcccctgcccttccgggttcgtggtaatgagatgccggccccgcgctcccgttggcccccgccggccccaaaggggccggcgaggtcgccccgttggtccgcgggcggctccgccccaaagggggcggggccgcagggtaaaagaagtgagaacgcgaagcgttcgcacttcgtcctaatagtatatatattattagggcaaagtgcgagcgctggcgccctgcccggggcccgcgtcatcccgcgggctccgccccaaagggggcggggccgcagggtaaaagaagtgagaacgcgaagcgttcgcacttcgtcctaatagtatatatattattagggcaaagtgcgagcactggcgccctgcccggggcccgcgtcatcccgcgggctccgccccgaggcgggcccggacggggggcgggccgttcctcgcgcacataaagggccggcgtcccggtcgccgccgcaccaggggcacaccggctgcgcggcggagaccgggacggcagcggcggcatcgcgaagggggccacagcgagacagagacgccggcggcgagcggggcaccgacgcacccggatcggatcggatacagagacgcgggcgcatcggttccttttcgttctgcctttccctcccccccccccccccaccctgtacgtaccgcgaggacccatccacccactgcagccttatcgcaggtacggtgacccggggggccgggccggggggacgggccggggggacgggccggggggacgggccggggggacgggccggggggacgggccggggggacgggccggggggacgggccggggggacgggccggggggccggggggccggggggccggggggacggggggacgggccggggggacgggccggggggccggggggacggggggacggggggacggggggacggggggacggggggacggggggacggggggacggggggacggggggacggggggacggggggacggggggacggggggacggggggacgggccggggggacggggggacgggccggggggacggggggacggggccccgatcccaacatccgcgctttctcgcaggccgggcgccgccttcgtggacgggacaccggtgtggtaactggcgacaaggcgttgccactatggcagacatccccccggacccgcccgcgctcaacacgacgcctgcgaatcatgctcccccatccccacccccgggttcacggaagcgcagacgccccgtcctccccagctcgtcggaatctgagggtaagcccgacacagaatcggaatcctcctcgaccgagtcgtccgaggatgaggcgggagacctacgcggcgggcgccgtcgctccccgcgggagctcggggggaggtattttttggatctgtcggcagaatcgaccacggggacggaatcggagggaacggggccgtcggacgacgatgatgatgatgcgtcagacggctggttggttgacacacccccccgcaaatccaagcgaccccgaatcaacctgcgattaacgagctcccccgaccggcgtgcgggtgtggttttccccgaggtgtggagaagcgacagacctatccgcgcggcgcaaccccaggccccggcccagtcttccggggatcgcgcagccgcaccgcggcgctctgctcgccaggcccagatgcggagcggagccgcctggacgcttgatctgcattacatacgccagtgcgtcaaccagctctttcggatcctgcgtgccgccccgaacccgcccggcagcgccaaccgcctgcgccacctggtgcgagactgctacctcatgggctactgccggacccgcctggggccgcgcacgtggggccgcctgctgcagatctcgggcggaacctgggacgtgcgcctgcgaaacgcaatccgggaggtcgaggcgcattttgaacccgccgccgagcccgtgtgcgagctgccctgtctgaacgccaggcgttacggccccgagtgtgatgttggcaatctcgagaccaacggcggctcgacgagcgatgatgagatatcggatgcgacggactcggacgataccctcgcgtcccattccgacacggagggggggccctccccggccggccgggagaacccggaatccgcgtccggcggggctatcgcggctcggctggagtgtgagtttgggacgtttgactggacgtccgaggagggctcccagccctggctgtccgcggtggtcgccgataccagctccgccgaacgctctggcctacccgccccgggcgcgtgtcgcgcaacggaagccccagaacgcgaggacgggtgccgaaaaatgcgcttccccgccgcctgcccctatccctgcggccacacatttctccggccatgagcgcgggacccccagcccggtgtgtttgccaaacgaaaaataaacgccctacaagaaagcttttgtgtctgagtgtctggtttttctgggggtggaggaaggaacgacaaaaaaaagaaacaaacgcgacaccgctcgtacgtgtaatggggcgcagtgttttttattagcatcggggggggttagaggttggtgattggatagcaaacgtgggatgacggaggccactcgtcgccaacggccagcgggggcccggggttctgggggtcatcgtcccccgtctgccaggagggctcatcgggaatctcgggtcgccccatgcacgtaaaacacgggcgctgcgtggggtgggtcgccggatgcgggcgggatgatgcggggcggggtttgttgtgaggagccacgagggaccgtagccagcgaagacagctgcgttcccggtcgccgggcaccaccacgccgtattggtattcgtatcggctaaggagattttccagggggtgattaggcgctgcggggaacggggtccacgacacggtccgctcgggcaaaaaccgatcgggcaggggccacggttcccccacccacgcgtcgttggtcttcgtggcgatgaagcgaaaccccagccgggttttttgtgcgtactcgaaaaacggcacacacaggtccgccgccccgaccacccacaggtggtatagccggtgggggccggggcgctcttgatgcaggagccgaaaacacgcaggggcatccagaatctcgatgctttccagggggtcgtcctccgcaaacaggcccgtcgtggtgtttgggggacagcgacaggagcgggttcgcacgatcggtcgggtgaatttgggcaagtccatcagaggctcggccagcctgcgaaggttcgccgggcgaaccaccaccggggttcccagaggctcggaggccaggatccggcattgccgaagcagaaaactccacagagccgggcttgcgtcagcggaagtccgcggcagggcgtttcgttggtctaggagggtaaccacacttacaacaacaacgcccatgtcggtatattaggcccgtggtccgatcttcactcactcgcctgtctgcggacctatgcacggcgggacggcgcgcggacccgggggggctgcttgctatcacacggcccgttcgcacgttcgattttttcagccttgtttggttggctaggtatcccggataatctgacgttccggatatagggggcggggggtagtggggggtgtgtcgacaaactgccgcttcttaaaacaccggggcccgtcgctcggggtgctcgttggttggcacgcgcgacgcggcaaatggcctgtcgtaagttctgtggggtctaccgtagacccgacaagagacaggaggcgtccgtcccgccggagacaaacacggccccggccttcccggcgagcaccttttatacccccgcggaggatgcgtacctggcccccgggcccccggaaaccatccacccttcccgcccaccgtcccccggcgaggctgcgcgcctgtgtcagctgcaggagatcttggcccagatgcacagcgacgaggactaccccatcgtggacgccgcgggtgcggaggaggaagacgaggccgacgatgacgccccggatgacgtggcctacccggaggactacgcggaggggcgttttctgtccatggtttcggccgcccccctgcccggagccagcggccatcctcctgttccgggccgcgcagccccccccgacgtccggacctgcgacagcggtaaggtgggggccacggggttcaccccggaagagctcgacaccatggaccgggaggcacttcgggccatcagccgcgggtgcaagcccccttcgaccctggcaaaactggtgaccgggctgggattcgcgatccacggagcgctcatcccggggtcggaggggtgtgtctttgatagcagccacccgaactaccctcatcgggtaatcgtcaaggcggggtggtacgccagcacgagccacgaggcgcggctgctgagacgcctgaaccaccccgcgatcctacccctcctggacctgcacgtcgtttctggggtcacgtgtctggtcctccccaagtatcactgcgacctgtatacctatctgagcaagcgcccgtctccgttgggccacctacagataaccgcggtctcccggcagctcttgagcgccatcgactacgtccactgcgaaggcatcatccaccgcgatattaagaccgagaacatcttcatcaacacccccgagaacatctgtctgggggactttggggcggcgtgctttgtgcgcgggtgtcgatcgagccccttccattacgggatcgcaggcaccatcgatacaaacgcccccgaggtcctggccggggatccgtacacccaggtaatcgacatctggagcgccggcctggtgatctttgagaccgccgtccacaccgcgtccttgttctcggccccgcgcgaccccgaaaggcggccgtgcgacaaccagatcgcgcgcatcatccgacaggcccaggtacacgtcgacgagtttccgacgcacgcggaatcgcgcctcaccgcgcactaccgctcgcgggcggccgggaacaatcgtccggcgtggacccgaccggcgtggacccgctactacaagatccacacagacgtcgaatatctcatatgcaaagcccttacctttgacgcggcgctccgcccaagcgccgcggagttgctgcgcctgccgctatttcaccctaagtgaccccgctccccccggggggcgtggaggggggggctggttggatgtttttgcacaaaaagacgcggccctcgggctttggtgtttttggcaccttgccgcccggcgtcatgcacgccatcgctcccaggttgcttcttctttttgttctttctggtcttccggggacacgcggcgggtcgggtgtccccggaccaattaatccccccaacagcgatgttgttttcccgggaggttcccccgtggctcaatattgttatgcctatccccggttggacgatcccgggcccttgggttccgcggacgccgggcggcaagacctgccccggcgcgtcgtccgtcacgagcccctgggccgctcgttcctcacgggggggctggttttgctggcgccgccggtacgcggatttggcgcacccaacgcaacgtatgcggcccgtgtgacgtactaccggctcacccgcgcctgccgtcagcccatcctccttcggcagtatggagggtgtcgcggcggcgagccgccgtccccaaagacgtgcgggtcgtacacgtacacgtaccagggcggcgggcctccgacccggtacgctctcgtaaatgcttccctgctggtgccgatctgggaccgcgccgcggagacattcgagtaccagatcgaactcggcggcgagctgcacgtgggtctgttgtgggtagaggtgggcggggagggccccggccccaccgcccccccacaggcggcgcgtgcggagggcggcccgtgcgtccccccggtccccgcgggccgcccgtggcgctcggtgcccccggtatggtattccgcccccaaccccgggtttcgtggcctgcgtttccgggagcgctgtctgcccccacagacgcccgccgcccccagcgacctaccacgcgtcgcttttgctccccagagcctgctggtggggattacgggccgcacgtttattcggatggcacgacccacggaagacgtcggggtcctgccgccccattgggcccccggggccctagatgacggtccgtacgcccccttcccaccccgcccgcggtttcgacgcgccctgcggacagaccccgagggggtcgaccccgacgttcgggccccccgaaccgggcggcgcctcatggccttgaccgaggacacgtcctccgattcgcctacgtccgctccggagaagacgcccctccctgtgtcggccaccgccatggcaccctcagtcgacccaagcgcggaaccgaccgcccccgcaaccactactccccccgacgagatggccacacaagccgcaacggtcgccgttacgccggaggaaacggcagtcgcctccccgcccgcgactgcatccgtggagtcgtcgccactccccgccgcggcggcggcaacgcccggggccgggcacacgaacaccagcagcgcctccgcagcgaaaacgccccccaccacaccagcccccacgacccccccgcccacgtctacccacgcgaccccccgccccacgactccggggccccaaacaacccctcccggacccgcaaccccgggtccggtgggcgcctccgccgcgcccacggccgattcccccctcaccgcctcgccccccgctaccgcgccggggccctcggccgccaacgtttcggtcgccgcgaccaccgccacgcccggaacccggggcaccgcccgtacccccccaacggacccaaagacgcacccacacggacccgcggacgctccccccggctcgccagcccccccaccccccgaacatcgcggcggacccgaggagtttgagggcgccggggacggcgaaccccccgaggacgacgacagcgccaccggcctcgccttccgaactccgaaccccaacaaaccaccccccgcgcgccccgggcccatccgccccacgctcccgccaggaattcttgggccgctcgcccccaacacgcctcgcccccccgcccaagctcccgctaaggacatgccctcgggccccacaccccaacacatccccctgttctggttcctaacggcctcccctgctctagatatcctctttatcatcagcaccaccatccacacggcggcgttcgtttgtctggtcgccttggcagcacaactttggcgcggccgggcggggcgcaggcgatacgcgcacccgagcgtgcgttacgtatgtctgccacccgagcgggattagggggtgggggtggggggcgagaaacgatgaaggacgggaaagggaacagcgaccaaatgtcacgataagaacaataaacctgtgacgtcaatcagatatgtgagtttggttgtgttttgtgggactgggggcggggggtgggaggtatcagtgggtgacagagtcttttaaaagacgtgtcccggggccctcgagacgcgcaacttttggccacacagagaaaggcccccagacgaagtcacccgggtccccgaacaaaaacaaaaaccttgaccgccgccggggggcgtgcctgttgttttggtctcaatggatcggtatgccgttcggacctgggggattgtgggaatcctcgggtgtgctgctgttggggccgcacccaccggccccgcgtccgatacaacaaacgcgaccgcacgcctccccacgcaccccccactcatccgttccgggggctttgccgtccccctcatcgtgggggggctgtgtctcatgattctggggatggcgtgtctactcgaggtcctgcgtcgcctgggtcgcgagttggcgaggtgctgcccccacgcgggccaatttgccccatgatttttcgcctttctggccttgcccccaccccatcgccccgattgtgtgtcgggtgcccggggtacagcagctatggagcggtcggtaatataactttggttgtcgccacacgccccgtgccgggcatgggttgtgcgggaaggacgaaataatccggcgatccccaagcgtaccaactgggggggggggggggaaaagaaactaaaaacacatcaagcccacaacccatcccacaatgggggttatggcggacccaccgcaccaccatactccgattcgaccacatatgcaaccaaatcacccccagaggggaggttccatttttacgaggaggaggagtataatagagtctttgtgtttaaaacccggggtcggtgtggtgttcggtcataagctgcattgcgaacgactagtcgccgtttttcgtgtgcatcgcgtatcacggcatggggcgtttgacctccggcgtcgggacggcggccctgctagttgtcgcggtgggactccgcgtcgtctgcgccaaatacgccttagcagacccctcgcttaagatggccgatcccaatcgatttcgcgggaagaaccttccggttttggaccagctgaccgacccccccggggtgaagcgtgtttaccacattcagccgagcctggaggacccgttccagccccccagcatcccgatcactgtgtactacgcagtgctggaacgtgcctgccgcagcgtgctcctacatgccccatcggaggccccccagatcgtgcgcggggcttcggacgaggcccgaaagcacacgtacaacctgaccatcgcctggtatcgcatgggagacaattgcgctatccccatcacggttatggaatacaccgagtgcccctacaacaagtcgttgggggtctgccccatccgaacgcagccccgctggagctactatgacagctttagcgccgtcagcgaggataacctgggattcctgatgcacgcccccgccttcgagaccgcgggtacgtacctgcggctagtgaagataaacgactggacggagatcacacaatttatcctggagcaccgggcccgcgcctcctgcaagtacgctctccccctgcgcatccccccggcagcgtgcctcacctcgaaggcctaccaacagggcgtgacggtcgacagcatcgggatgctaccccgctttatccccgaaaaccagcgcaccgtcgccctatacagcttaaaaatcgccgggtggcacggccccaagcccccgtacaccagcaccctgctgccgccggagctgtccgacaccaccaacgccacgcaacccgaactcgttccggaagaccccgaggactcggccctcttagaggatcccgccgggacggtgtcttcgcagatccccccaaactggcacatcccgtcgatccaggacgtcgcgccgcaccacgcccccgccgcccccagcaacccgggcctgatcatcggcgcgctggccggcagtaccctggcggtgctggtcatcggcggtattgcgttttgggtacgccgccgcgctcagatggcccccaagcgcctacgtctcccccacatccgggatgacgacgcgcccccctcgcaccagccattgttttactagaggagtttccccgctcccgtgtacctctgggcccgtgtgggagggtggctggggtatttgggtgggacttggactccgcataaagggagtctcgaaggagggaaactaggacagttcataggccgggagcgtggggcgcgcaccgctgtcccgacgattagccaccgcgcccacagccacctcgacccgtccgatcccggtatgcccggccgctcgctgcagggcctggcgatcctgggcctgtgggtctgcgccaccggcctggtcgtccgcggccccacggtcagtctggtctcagactcactcgtggatgccggggccgtggggccccagggcttcgtggaagaggacctgcgtgttttcggggagcttcattttgtgggggcccaggtcccccacacaaactactacgacggcatcatcgagctgtttcactaccccctggggaaccactgcccccgcgttgtacacgtggtcacactgaccgcatgcccccgccgccccgccgtggcgttcaccttgtgtcgctcgacgcaccacgcccacagccccgcctatccgaccctggagctgggtctggcgcggcagccgcttctgcgggttcgaacggcaacgcgcgactatgccggtctgtatgtcctgcgcgtatgggtcggcagcgcgacgaacgccagccggtttgttttgggggtggcgctctctgccaacgggacgtttgtgtataacggctcggactacggctcctgcgatccggcgcagcttcccttttcggccccgcgcctgggaccctcgagcgtatacacccccggagcctcccgacccacccctccacggacaacgacacccccgtcctccccccgagacccgacccccgcccccggggacacagggacgcccgcgcccgcgagcggcgagatagccccgcccaattccacgcgatcggccagcgaatcgagacacaggctaaccgtagcccaggtaatccagatcgccataccggcgtccatcatcgcctttgtgtttctgggcagctgtatctgcttcatccatagatgccagcgccgatacaggcgcccccgcggccagatttacaaccccgggggcgtttcctgcgcggtcaacgaggcggccatggcccgcctcggagccgagctgcgatcccacccaaacaccccccccaaaccccgacgccgttcgtcgtcgtccacgaccatgccttccctaacgtcgatagctgaggaatcggagccaggtccagtcgtgctgctgtccgtcagtcctcggccccgcagtggcccgacggccccccaagaggtctaggtccaagcgggccgttcggcaggcccgccccaccgcccccatcgtggttatttccccccccccccaataaaccgatgttatttgcctatatgcgtgtgttggatccctttgtgatcgttcgtcattccccggatggcatgggaggcgggtaatggatgggcggggcccgggggggaggaaaaagaataaagggggtagtgtcggagaggcccgccgcgcatttaaggagtcgccgccccgactctgtgtcttcgggtgacttggtgcgccgccgtcagctagtctccgatctgccccgaccgacggctcctgccacccgaacatggctcgcggggccgggttggtgttttttgttggagtttgggtcgtatcgtgcctggcggcagcacccagaacgtcctggaaacgggtaacctcgggcgaggacgtggtgttgcttccggcgcccgcggaacgcacccgggcccacaaactactgtgggccgcggaacccctggatgcctgcggtcccctgcgcccgtcgtgggtggcgctgtggcccccccgacgggtgctcgagacggtcgtggatgcggcgtgcatgcgcgccccggaaccgctcgccatagcatacagtcccccgttccccgcgggcgacgagggactgtattcggagttggcgtggcgcgatcgcgtagccgtggtcaacgagagtctggtcatctacggggccctggagacggacagcggtctgtacaccctgtccgtggtcggcctaagcgacgaggcgcgccaagtggcgtcggtggttctggtcgtggagcccgcccctgtgccgaccccgacccccgacgactacgacgaagaagacgacgcgggcgtgagcgaacgcacgccggtcagcgttccccccccaacccccccccgtcgtccccccgtcgcccccccgacgcaccctcgtgttatccccgaggtgtcccacgtgcgcggggtaacggtccatatggagaccccggaggccattctgtttgcccccggggagacgtttgggacgaacgtctccatccacgccattgcccacgacgacggtccgtacgccatggacgtcgtctggatgcggtttgacgtgccgtcctcgtgcgccgagatgcggatctacgaagcttgtctgtatcacccgcagcttccagagtgtctatctccggccgacgcgccgtgcgccgtaagttcctgggcgtaccgcctggcggtccgcagctacgccggctgttccaggactacgcccccgccgcgatgttttgccgaggctcgcatggaaccggtcccggggttggcgtggctggcctccaccgtcaatctggaattccagcacgcctccccccagcacgccggcctctacctgtgcgtggtgtacgtggacgatcatatccacgcctggggccacatgaccatcagcaccgcggcgcagtaccggaacgcggtggtggaacagcacctcccccagcgccagcccgagcccgtcgagcccacccgcccgcacgtgagagccccccatcccgcgccctccgcgcgcggcccgctgcgcctcggggcggtgctgggggcggccctgttgctggccgccctcgggctgtccgcgtgggcgtgcatgacctgctggcgcaggcgctcctggcgggcggttaaaagccgggcctcggcgacgggccccacttacattcgcgtggcggacagcgagctgtacgcggactggagttcggacagcgagggggagcgcgacgggtccctgtggcaggaccctccggagagacccgactctccctccacaaatggatccggctttgagatcttatcaccaacggctccgtctgtatacccccatagcgaggggcgtaaatctcgccgcccgctcaccacctttggttcgggaagcccgggccgtcgtcactcccaggcctcctatccgtccgtcctctggtaaggcgtcttccgacgacgcggacgtcggcgatgaactgattgccatcgcggacgcacgcggggacccgccagagaccctgccccccggcgcgggcggcgccgcgcccgcgtgccgcagaccacctcgcggcggctcccccgcggcctttcccgtggccctccacgccgtggacgccccctcccaattcgtcacctggctcgccgtgcgctggctgcggggggcggtgggtctcggggccgtcctgtgcgggattgcgttttacgtgacgtcaatcgcccgaggcgcataaaggtccggcggccagccccgccgcagctcataaaaatcgtgagtcacggcaaccgcaccttcgcctccggccctccgccagcgcccttccgcgtccgcgatgacctcccggcccgccgaccaagactcggtgcgttccagcgcgtcggtgccgctttaccccgcggcctcgcccgtcccggcagaagcctactactcggaaagcgaagacgaggccgccaacgacttcctcgtgcgcatgggccgccagcagtcggtcctaaggcgccgacggcggcgcacgcggtgcgtcgggctggttatcgcctgtctcgtcgtggccctcctatctggagggttcggggcacttttggtgtggctgctccgctaaatgacgcctcgatgtatggcgccttcttcgcccccacccctcgccgcgacccacgtccgtatgttaattgcaataaagtggttgattgtcattacggtctactaggttgtcttttttttttgggggggggggaggaaatgcagaaaagggtaagaaattctcggaatttcacccccgggggggggcaagtgcagtaacccagttcctcagtgtttgggaaatctattgaactctcccggctcctccgtgttagggaagtctcttggggaaatctattgacctctcgccccccccccccaggaggggggcagtgcagtaccccagttcctccgtgctggggaaatctctctgccgggtacgggctccagacgaaggacccatacatttccccatccgcaccccacatctggcgttctagagtcacgacgcatttgcccccgtccccgcagcaacacacaaagcgatttcaattttcacgattttattattaattacaccaaccaccctgtccccgggacgtggtcaggaccgggggtccgcacccaaacgcacgaaacaaatgctggcagtgtgccgaatataaccccgcgtaggaacacgtcgacgcgtgcgccaaacagcaccagaaggcgcatgccatcagcaggtcgtgcatatggcgatgtgtttggacgcagggcgcagccgcggcgataaaattcatggcggccgtccgccagggccacagcggcgaggactccctgttggcccgaagccattgggtatgaaccagctgcgcctcctgtccgaccctggctcccgccagcgggggcggtgggtcgtgggtgttgagagcacacaggcgggacacctcgatcaccgtccgaaaaaaggcccggtggtccgcgggcagcatctgcaggtgcgccagggcctgggcgttgagagggtacaactcggagccgggggactccgggggccggtccgcgcggtgccgcgagttggcacgctttggggcccgggtgtcggacgcgggcgcgttatggatcccgacgcggggcagaacgtacgtgcgttggcgcggcgatgaggggtccgggctgccgaggggggcgtaggggaccgggctaggcaagcccgcgggttgcgcggggttcccgtgggggtctaggctccctgggcacccgtgggggtcgtgggggtcgcgggtccctgggtatgcgcgggaccctgggttctctgggagatcgtggaactcgcggttccctgggctctcggggaacccggggctccctggggacacgtggtgccctgggaattcttgatggtcggacggcttcagatggcttcgggatcgagagggccgcacagactcgtagtagacccgaatctccacgtttccccgccgccggatcatggtcgccgccccggtgcgggggcccgtcggtcggaagcgagtgcccttcaagcgtgtccgctcctctgggctgcatgccgtcggatggggtgccttttaaggaaaggtctcggctgcccgccccaaccggggtttgggggtgggccggggaaaccccggatgccatgggggggtcacaccctaagcgccggcgcgctggttgggtgggggtagaggggagtccccggtcgacgagatcgtataagctgggtaccgagctcgaattcatcgatgatatcagatcgatccccatggtgtcccgtccacgaaggcggcgcccggcctgcgagaaagcgcggatgttgggatcggggccccgtccccccgttccccggcccgtccccccgtccccccggcccgtccccccggcccgtccccccggcccggccccccgggtcaccgtacctgcgataaggctgcagtgggtggatgggtcctcgcggtacgtacagggtgggggggggggggggagggaaaggcagaacgaaaaggaaccgatgcgcccgcgtctctgtatccgatccgatccgggtgcgtcggtgccccgctcgccgccggcgtctctgtctcgctgtggcccccttcgcgatgccgccgctgccgtcccggtctccgccgcgcagccggtgtgcccctggtgcggcggcgaccgggacgccggccctttatgtgcgcgaggaacggcccgccccccgtccgggcccgcctcggggcggagcccgcgggatgacgcgggccccgggcagggcgccagtgctcgcactttgccctaataatatatatactattaggacgaagtgcgaacgcttcgcgttctcacttcttttaccctgcggccccgccccctttggggcggagcccgcgggatgacgcgggccccgggcagggcgccagcgctcgcactttgccctaataatatatatactattaggacgaagtgcgaacgcttcgcgttctcacttcttttaccctgcggccccgccccctttggggcggagccgcccgcggaccaacggggcgacctcgccggcccctttggggccggcgggggccaacgggagcgcggggccggcatctcattaccacgaacccggaagggcaggggagcgagcccgcccgcgacgagggtctcattagcatcgcgggcggaagcggaagccgcccgcgccgggcgctaatgagatgccgcgcgggcggagccggcggcggcgcgaccaacgggccgccgccacggacgcggacgcgcgggcgtcggggcggggccgcgcataatgcggttccacctgggggcggaaccccggcgagccggggcgcggcggcgtcgatcgctcctcctccgcgtcctcctcctttccccccgccccgcgcgccccgaggactatatcagccaggcgacggggcgatcgtccacacggagcgcggctaccgacgcggccgccaggatctacccgatcggcgcggagaggcgaaaagacacaggcacacgcacgcaccgcacgggggggagagagactgccaaccacccccccccactgccgcccctgaagaagaagaagaagacccccccccgcacaccccggtcggaggcgatgtcggcggagcagcggaagaagaagaagacgacgacgacgacgcagggccgcggggccgaggtcgcgatggcggacgaggacgggggacgtctccgggccgcggcggagacgaccggcggccccggatctccggatccagccgacggaccgccgcccaccccgaacccggaccgtcgccccgccgcgcggcccgggttcgggtggcacggtgggccggaggagaacgaagacgaggccgacgacgccgccgccgatgccgatgccgacgaggcggccccggcgtccggggaggccgtcgacgagcctgccgcggacggcgtcgtctcgccgcggcagctggccctgctggcctcgatggtggacgaggccgttcgcacgatcccgtcgccccccccggagcgcgacggcgcggaagaagaagcggcccgctcgccttctccgccgcggaccccctccatgcgcgccgattatggcgaggagaacgacgacgacgacgacgacgacgatgacgacgaccgcgacgcgggccgctgggtccgcggaccggagacgacgtccgcggtccgcggggcgtacccggaccccatggccagcctgtcgccgcgacccccggcgccccgccgacaccaccaccaccaccaccaccgccgccggcgcgccccccgccggcgctcggccgcctctgactcatcaaaatccggatcctcgtcgtcggcgtcctccgcctcctcctccgcctcctcctcctcgtctgcatccgcctcctcgtctgacgacgacgacgacgacgacgccgcccgcgcccccgccagcgccgcagaccacgccgcgggcgggaccctcggcgcggacgacgaggaggcgggggtgcccgcgagggccccgggggcggcgccccggccgagcccgcccagggccgagcccgccccggcccggacccccgcggcgaccgcgggccgcctggagcgccgccgggcccgcgcggcggtggccggccgcgacgccacgggccgcttcacggccgggcggccccggcgggtcgagctggacgccgacgcggcctccggcgccttctacgcgcgctaccgcgacgggtacgtcagcggggagccgtggcccggggccggccccccgcccccggggcgcgtgctgtacggcgggctgggcgacagccgccccggcctctggggggcgcccgaggcggaggaggcgcgggcccggttcgaggcctcgggcgccccggcgcccgtgtgggcgcccgagctgggcgacgcggcgcagcagtacgccctgatcacgcggctgctgtacacgccggacgcggaggcgatggggtggctccagaacccgcgcgtggcgcccggggacgtggcgctggaccaggcctgcttccggatctcgggcgcggcgcgcaacagcagctccttcatctccggcagcgtggcgcgggccgtgccccacctggggtacgccatggcggcgggccgcttcggctggggcctggcgcacgtggcggccgccgtggccatgagccgccgctacgaccgcgcgcagaagggcttcctgctgaccagcctgcgccgcgcctacgcgcccctgctggcgcgcgagaacgcggcgctgaccggggcgcgaacccccgacgacggcggcgacgccaaccgccacgacggcgacgacgcccgcgggaagcccgccgccgccgccgccccgttgccgtcggcggcggcgtcgccggccgacgagcgcgcggtgcccgccggctacggcgccgcgggggtgctcgccgccctggggcgcctgagcgccgcgcccgcctccgcgccggccggggccgacgacgacgacgacgacgacggcgccggcggtggtggcggcggccggcgcgcggaggcgggccgcgtggccgtggagtgcctggccgcctgccgcgggatcctggaggcgctggcggagggcttcgacggcgacctggcggccgtgccggggctggccggagcccggcccgccgcgcccccgcgcccggggcccgcgggcgcggccgccccgccgcacgccgacgcgccccgcctgcgcgcctggctgcgcgagctgcggttcgtgcgcgacgcgctggtgctgatgcgcctgcgcggggacctgcgcgtggccggcggcagcgaggccgccgtggccgccgtgcgcgccgtgagcctggtcgccggggccctgggcccggcgctgccgcggagcccgcgcctgctgagctccgccgccgccgccgccgcggacctgctcttccagaaccagagcctgcgccccctgctggccgacaccgtcgccgcggccgactcgctcgccgcgcccgcctccgcgccgcgggaggcgcgcaagcgcaagagccccgccccggccagggcgccgccgggcggcgccccgcgccccccgaagaagagccgcgcggacgccccccgccccgcggccgcccctcccgcgggggccgcgccccccgccccgccgacgccgccgccgcggccgccgcgccccgcggcgctgacccgccggcccgccgagggccccgacccgcagggcggctggcgccgccagccgccggggcccagccacacgccggcgccctcggccgccgccctggaggcctactgcgccccgcgggccgtggccgagctcacggaccacccgctcttccccgcgccgtggcgcccggccctcatgttcgacccgcgcgcgctggcctcgctggccgcgcgctgcgccgccccgccccccggcggcgcgcccgccgccttcggcccgctgcgcgcctcgggcccgctgcgccgcgcggcggcctggatgcgccaggtgcccgacccggaggacgtgcgcgtggtgatcctctactcgccgctgccgggcgaggacctggccgcgggccgcgccgggggcgggccccccccggagtggtccgccgagcgcggcgggctgtcctgcctgctggcggccctgggcaaccggctctgcgggcccgccacggccgcctgggcgggcaactggaccggcgcccccgacgtctcggcgctgggcgcgcagggcgtgctgctgctgtccacgcgggacctggccttcgccggcgccgtggagttcctggggctgctggccggcgcctgcgaccgccgcctcatcgtcgtcaacgccgtgcgcgccgcggactggcccgccgacgggcccgtggtctcgcggcagcacgcctacctggcctgcgaggtgctgcccgccgtgcagtgcgccgtgcgctggccggcggcgcgggacctgcgccgcaccgtgctggcctccggccgcgtgttcgggccgggggtcttcgcgcgcgtggaggccgcgcacgcgcgcctgtaccccgacgcgccgccgctgcgcctctgccgcggggccaacgtgcggtaccgcgtgcgcacgcgcttcggccccgacacgctggtgcccatgtccccgcgcgagtaccgccgcgccgtgctcccggcgctggacggccgggccgccgcctcgggcgcgggcgacgccatggcgcccggcgcgccggacttctgcgaggacgaggcgcactcgcaccgcgcctgcgcgcgctggggcctgggcgcgccgctgcggcccgtctacgtggcgctggggcgcgacgccgtgcgcggcggcccggcggagctgcgcgggccgcggcgggagttctgcgcgcgggcgctgctcgagcccgacggcgacgcgcccccgctggtgctgcgcgacgacgcggacgcgggcccgcccccgcagatacgctgggcgtcggccgcgggccgcgcggggacggtgctggccgcggcgggcggcggcgtggaggtggtggggaccgccgcggggctggccacgccgccgaggcgcgagcccgtggacatggacgcggagctggaggacgacgacgacggactgtttggggagtgacgggggggaaacttccgggagcgggggaggggggagatggggagagggggaaggaatcgggcgtctgtgcgcctttaagacagacgcggcgatggccgcgcgcgtgtgtgagaaataaagaacgagacagacgaaaacgtaccgccttgtgtggtttattcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggtgggcggcacgtctcccgcgcccgcggggggtctggggctctgacctgagtgcaggttacgaaggtcaggtggcccgagcccccccgcaggagcgggagggaaggcacggggcgcgggagggaggggctgctgcgagctcggggccgcgggcgcggggggaggggcgggggaagcccccggggcggggcgcgggggaggcggccgcgggggaggcggccgcgggaccgcagccccgtggcgcgcgggggggaggggctgccgcgagctcggcgggatggaggggagggagggggtggcggggaaccgtgtgcgggcgggcgggtgcttggtgcaactgtctggtctgcgagggcgagcggtggtgcgactggcgtcttcgggggggcggggagcttgggagtgtgtggtggtctgcggcacagcctgctagtccccgtcttgccgcgcgggggcgggcgcgggaaaaaagccgcgcgggggcgcccgcgggaaggcagccccgcggcgcgcggggggaggggcggcgcccgcgggggagcggccggctccgggggagggacggggaagggggcgcgcggggctgccctgccgcccgcccgccgccgccgcccgccttcgcgcccccccccaaaaaacaccccccccgggggttgactccccgggggaaaagaggcggggcggg

SEQ ID NO: 17 - DNA, 154949 bp, synthetic construct
  source 1..154949: mol_type = other DNA
agtccccgtcttgccgcgcgggggcgggcgcgggaaaaaagccgcgcgggggcgcccgcgggaaggcagccccgcggcgcgcggggggaggggcggcgcccgcgggggagcggccggctccgggggagggacggggaagggggcgcgcggggctgccctgccgcccgcccgccgccgccgcccgccttcgcgcccccccccaaaaaacaccccccccgggggttgactccccgggggaaaagaggcggggcgggagtccccgtcctgccgccgccccttaagagggcccgcaacacggcccgggctgcgcacgccagccgggacgggtgagttcgctaggcaagcacggactggcggttacacggataacctggttctttccgcctcagaagccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagcatttaggtgacactatagaatagggccctctagctcgagttaaaggacacagaattcaccaggattttgatggataagaatcagttctccgccattcacatggaagtcatccagggaggtattgtcagtggtcacattcaagtagactttgtctttgtaagtcagagaggccaccatcaaggagttgacagacctgaccttcttcagttggaagaggggctcctcatccttctggtaatgaaggctaatgttgacttcctgggagaagtagcccttcagggagatgagataaaacccatcacagttgatgatgactgagttgttctgcaccttcatgatttcatcctccttttgggaagtgaggatgaaacctttctccttcttatattcggtaaattgtactttgatactttgaattcgaggataccgatgtgatacctgaagagcagagaagtgcaggcagatgtaggtgaagcacaggagcagccccagtccctgaattacagaggccaccagcaatagcttgttcctctcgaatcttggcctggctgcatttcccacattctcttccaggggttggaccctttccatggatccagcttgggtctccctatagtgagtcgtattaatttcgataagccagtaagcagtgggttctctagttagccagagagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacgcgtatatctggcccgtacatcgatcatcgatgaattcgagctcggtacccggggatcctctagaccggcttcccggtatggtaattagaaacttttaataggcggtcccggccgccatccccgcgcatggtaattagcaacttttaatgggccggcgttcccgctcgcggtaattagcagcttttaacgggccgccattcccgcttatggtaattaaaaacgttcggacggcccctcgctccccgcgtaattactccctcggggttccgggttatgctgattactttcttggcagaacacgcagagcctcgcgcgccgccgggtgggtgggctgatcggcccctattggtcccctgggcttcctagtatgctaatgaatttctccccgggggcgggcaccactcagggccgcgccggcggggcgccggggggactcccatctgcgtcggcggggggcggcgcatgctaatggggttcttggagtacacccggttggtccccggggacggggccgccccgagagggggggattccctccctccgcccccgccggggcgcgcggctattgggggaatcgtaaatgccgcccctttgggggagtggataggcgccgggtataaggcagccccgtgtgacggtcgggccgcattcgcaccccggcactgcgagcgacggagcggcggcccggcgggaggaggagacccggagagacagagactaaaacccggcaagagagagaccgcgggccgccgtctcgagtctaccctaccccggctcatggaaccccggcccggcacgagctcccgggcggaccccggccccgagcggccgccgcggcagacccccggcacggtgagagggcgacccccgggtctcaggcccccccttttccccggaccacccggctgcgggttgggggtggtcgcgggcggtgggctcgggggcggggacgcttgacggggccgacccccggcccgcttaagcggtcgggggacccccgtgggccgtgcgccgccccccgaccctctgggggggcgagggaggcagggaggagcccgagagcgggggacagggggggagacgaggggtcggaatccaaaggacgcagaccacctttggttacggacccctttctcccccccttccgaacaaaaagcagcgggcggggggccggggtgagggagggacacgggggacacggcgcgggggtcccgcctcacgccccgcgccctctaaatcccccccgttgctttgtcaagcagcccgccgccccgcacgcctgggggatgctcaacgacatgcagtggctcgccagcagcgactcggaggaggagaccgaggtgggaatctctgacgacgaccttcaccgcgactccacctccgaggcgggcagcacggacacggagatgttcgaggcgggcctgatggacgcggccacgcccccggcccggcccccggccgagcgccagggcagccccacgcccgccgacgcgcagggatcctgcgggggtgggcccgtgggtgaggaggaagcggaagcgggaggggggggcgacgtgtgcgccgtgtgcacggacgagatcgccccgcccctgcgctgccagagttttccctgcctgcaccccttctgcatcccgtgcatgaagacctggattccgttgcgcaacacgtgtcccctgtgcaacaccccggtggcgtacctgatagtgggcgtgaccgccagcgggtcgttcagcaccatcccgatagtgaacgacccccggacccgcgtggaggccgaggcggccgtgcgggccggcacggccgtggactttatctggacgggcaaccagcggacggccccgcgctccctgtcgctggggggacacacggtccgcgccctgtcgcccacccccccgtggcccggcacggacgacgaggacgatgacctggccgacggtgagggcgggcgggggtcgggcgggggtcgggcgggggtcgggcgggggtcgggcgggggtcgggcgggggtcgggcgggggtcgggcgggggtcgggcgggggtcgggcgggggtcgggcgggggtcgggcgggggtcgggcactaaccgggggctcccgtctctgtctccctctgcagtggactacgtcccgcccgccccccgaagagcgccccggcgcgggggcggcggtgcgggggcgacccgcggaacctcccagcccgccgcgacccgaccggcgccccctggcgccccgcggagcagcagcagcggcggcgccccgttgcgggcgggggtgggatctgggtctgggggcggccctgccgtcgcggccgtcgtgccgagagtggcctctcttccccctgcggccggcggggggcgcgcgcaggcgcggcgggtgggcgaagacgccgcggcggcggagggcaggacgccccccgcgggacagccccgcgcggcccaggagccccccatagtcatcagcgactctcccccgccgtctccgcgccgccccgcgggccccgggccgctctcctttttctcctcctcctccgcgcaggtgtcctcgggccccggggggggaggtctgccacagtcgtcggggcgcgcggcgcgcccccgcgcggccgtcgccccgcgcgtccggagtccgccccgcgccgccgccgcccccgtggtgtctgcgagcgcggacgcggccgggcccgcgccgcccgccgtgccggtggacgcgcaccgcgcgccccggtcgcgcatgacccaggctcagaccgacacccaagcacagagtctgggccgggcaggcgcgaccgacgcgcgcgggtcgggagggccgggcgcggagggaggacccggggtcccccgcggcaccaacacccccggtgccgccccccacgccgcggagggggcggcggcccgcccccggaagaggcgcgggtcggactcgggccctgcggcctcgtcctccgcctcttcctccgccgccccgcgctcgcccctcgccccccagggggtgggggccaagagggcggcgccgcgccgggccccggactcggactcgggcgaccgcggccacgggccgctcgccccggcgtccgcgggcgccgcgcccccgtcggcgtctccgtcgtcccaggccgcggtcgccgccgccgcctcctcttcctcctccgccgcctcctcttcctcctccgccgcctcctcttcctcctccgccgcctcctcttcctcctccgccgcctcttcctcctccgccgcctcctcttcctcctcctcctcctccgcctcttcctctgcgggcggggctggtgggagcgtcgcgtccgcgtccggcgctggggagagacgagaaacctccctcggcccccgcgctgctgcgccgcgggggccgaggaagtgtgccaggaagacgcgccacgcggagggcggccccgagcccggggcccgcgacccggcgcccggcctcacgcgctacctgcccatcgcgggggtctcgagcgtcgtggccctggcgccttacgtgaacaagacggtcacgggggactgcctgcccgtcctggacatggagacgggccacataggggcctacgtggtcctcgtggaccagacggggaacgtggcggacctgctgcgggccgcggcccccgcgtggagccgccgcaccctgctccccgagcacgcgcgcaactgcgtgaggccccccgactacccgacgccccccgcgtcggagtggaacagcctctggatgaccccggtgggcaacatgctctttgaccagggcaccctggtgggcgcgctggacttccacggcctccggtcgcgccacccgtggtctcgggagcagggcgcgcccgcgccggccggcgacgcccccgcgggccacggggagtagggggagctaacactcggcttgctgcccaaagggaagccgccccccaccggaccaccggccgaggcgcctcgggggcagggggaggtgggggggaaagacggggaggagacaggaagtgggggtgggagtggggggggacggacacggccccgaacagcaacacacaccagcattttgttatggactttctggccttgttgaaaacttgaggaaaaaaaactttatatttataaaaattttacaataaagttttgtgatgcttttgacacactttgttgttggcctttgatgcagctcccccgcgcaggggggccggggatggggggggggaaagggaggaggaggagggggggcgggcacgagaagccgcccccacccccgaggcctgttggtctttatgatagaacagagccggggcccggcctgcgttctggctccctgtcttggtgggtgggcgggctggctggcgggtaaaaaaagagtgtgtccgtgttgacagggaggggggcccgatcgtgcagagcacgcacgtctggccggccagaccctgggggtggtgggcaggagtgggagggcgcctggctcggggagggaggagggggggggtcagccgcaccaccggcgcgaagccaggggccagggaactttgatagagagggggggaaagtggggcgggggcgagggcggttgaatcacaacgcatgcacgccctctgcccccggggacgggtgggaggaaggaggagggagaagagaagacccgaggcatgcacccgcacttacgcccgtgcccacccccgccccggcgcccaccccgcccgcacacctgcccgccacgcccgcccctcctcaccctggctgggagaaaggaggaggagcaggaagaggagacccgaggcatgcaaccgcactcaccccaccccgcccgcacacctgcccgccacgcccgcccctccttaccctggctgcggggagactcccatcggggcgagggggctcgcgcgttcgcaacaccacaccacaccacacggcccaccacaacacggcccaccacgacacaacacgacacgacgcgttttgcggggcatgcaagtcgacacaccgcgcgcgtgcctacctttccctagcggccccggcccccggcccgtttccttccgccaccactaccaccacccccccgcccgcgcccacgcggtagaggaaggggacgggcgccacacccacggctgtggctgggcacgcgcctttggggttgttgggggggggtgaccggcgcgtgggggcggtgggcgtatgggcccgacccgcgcctgccccccctgggaacgacgcccccggacgacaccacgggggggggaaacgggggtgggtggaagggaagaggaaggagaaagggggggtggatccgaacacgccggatccgcgaaaataataacaaaacaaacaaaaacagaaacaaaaacaaaaacacctagaaaaaaaggatacgggttggctcgcgggcggtgcggctgacctgcctgccctttctgggacccccgcctcgtgtttcttgaaagggggaggaagaacagttctcccccaacccctgctctcttctctcttccgcccgccccccccccctctcccgccgcctcagcagaagctcacctgtacgaccctaaacctacctgcgagaacgcgcggcgttcgaggggcgcgctctctcacacgagacacacgcaggcgccccccccccccggagcctgggtcccccggcggacggctcacgcggcgcggcgtctcggtgggacgcgggcagagggcggcggcggcgggggggggggggaaatgtgaggagagcgagacagagagagagaaggaagagggaaggggcgcggcgggacgggggaagacgaggagaagggaaggggcgagggtcgggcccgggagcggggcggccgggagggagaagaaacggaacgcggaaacgccgccggcgcggcccggggccccggggcccccgcgctccgccgggggcccgggccggaccgccgggcgggggacgccttccgcccggcgccgggcggctacccgggacccccggccgggaatcgaaaaaagcctccgggggcccctttcgcgcctttcgcgaacgcgcggcgccggagggggcggccgccgaggtgcgggggcccctccggccggggcgcacctcggcggccaagccccggcccgcccgggggtccccgaggcagaggcggaccctcggaggcgcggaagaagacgggaggcgggggaaaaaagggggaagagagggggaggtagggaggggagaggagaagggcgcgccggtgcgcggagcagccttccttctccggagtccctctcgatcggcggcgggcccctgcgttcgttgctgccgcgcccccggttttataaagacagggatgacgcagcagaaatgcccacagcaacacgcgggcggggctcgggctctccggcggcttaatggatctccgggcacggcgcccgcaaccgcagagcactcagctggcgcgcccccccccaacgtgggagtgtttaatggaagggcgtggggccggccgccggatgcccgcgggggcctaatgcggcgggaggcgtgggccgctggcgccgcggcccgtctgctggcccgcggcccgtctgctggcccgcggccacgtaaacaatgacacaggggttctctccgccgcggccggcgcggggcgttgccggcccggcccggccccggagcccgcggcgctgctcggctgcggccgcgggctccgggggctccgcactctgcccggctcgccccgtcccccctcttgctgcttttccgcgcgcctctctttcccgttgctttccctctccccccccccccctctctctctctctctctctctctccgccatcctcccgcccggccgcccactccccgctcggcctctccggctgcggtgcttgggtctccttcgtcgggcggcggggggggggcgtcgggactcgcggagggccggagaatggaaggcgaggggatgcaggaggaggatcgggactccccatcttctgcccttccatcctccgtttttccgctttccaccgccgccgccaccacccccccttccttcgcccgcccgcctcgccccggacccctcccccccgtgttccccccatcgttcaccaccacgccccccaccgcgccttggctgtttggggggtggcggcggtggtcggcgtgctgccggaggctgcgggcgcggggtaggtgggtgggcgggtggtgggggggggcccggctgcgtctcgccgcgatcccgccggtggggcgcggcggcggtcggggtggggggagagtgtcgtgggtgtgttttcgtgtcccccaccaccactcccaccccgaccgccgccgcgcccgcgtttctgccgcccgcgcgctcctgtgtggaccccggggtgggcggcggggggggggtgccgtgggtgtggcggcggggcgcgggccggggccggggctcgctggtccgccgaagtaaagaaaagatcgccaccgtgtgttcgtctgtgtgttctgcgcggcgccggggcccccctgccgggcggggcggtggggcggggccggggtcgcggcggggaaggaaggaaagaccccggaagcgccgggagggggcgccggcgcgacgcgggcggccgggcgggggcgcgcggcggccgggcgggggcgcgcggcggccgggcgggggcgcgcggcggccgggcgggggcgcgcggcggccgggcgggggcgcgcggcggccgggcgggggcgcgcggcggccgggcgggggcgcgctttccccgcgtcgcccctcgggttcccaagacctatcacgtgtgcgcaggggaggggaggacgcgggggaggggaggacgcgggggaggggaggacgcgggggatatataaagcggtagaaagcgcgggaatgggcatattggacccgcgtgattcggttgctcgcggttgtcttgtttggacgttttttatgcgggaacaagggggcttaccggttacactgtccgctcgctatggggttcgtctgtctgtttgggcttgtcgttatgggagcctggggggcgtggggtgggtcacaggcaaccgaatatgttcttcgtagtgttattgccaaagaggtgggggacatactaagagtgccttgcatgcggacccccgcggacgatgtttcttggcgctacgaggccccgtccgttattgactatgcccgcatagacggaatatttcttcgctatcactgcccggggttggacacgtttttgtgggataggcacgcccagagggcgtatctggttaacccctttctctttgcggcgggatttttggaggacttgagtcactctgtgtttccggccgacacccaggaaacaacgacgcgccgggccctttataaagagatacgcgatgcgttgggcagtcgaaaacaggccgtcagccacgcacccgtcagggccgggtgtgtaaactttgactactcacgcactcgccgctgcgtcgggcgacgcgatttacggcctgccaacaccacgtcaacgtgggaaccgcctgtgtcgtcggacgatgaagcgagctcgcagtcgaagcccctcgccacccagccgcccgtcctcgccctttcgaacgcccccccacggcgggtctccccgacgcgaggtcggcgccggcatactcgcctccgacgcaactagccacgtctgcatcgcaagccaccctgggtcgggagcaggacagccgacccgtctagcggccgggtcggctgtccagcgtcgtcgccctagaggctgtccgccgggcgtgatgttttccgcatctacgacccccgaacagcccctggggctgtcgggcgatgcgacgccgcccctgccgacttccgtgcccctggactgggccgcgtttcggcgcgcgtttctgatcgacgacgcctggcggcccctgttggagccggagctcgcgaaccccctaaccgcgcgcctcctcgcggagtatgaccgtcggtgccagaccgaagaggtgctgccgccgcgggaggatgtgttctcctggacgcggtattgtacccccgacgacgtgcgcgtggttatcatcgggcaggacccgtaccaccatcccggccaggcgcacggcctggcgtttagcgtgcgtgcggatgtgccggtgcctccgagtctacggaacgtgctggcggcggttaaaaattgttaccccgacgcgcgcatgagcggccgcggctgcctggaaaagtgggctcgcgacggcgtgctgttgttgaacacgaccctgaccgtcaagcgcggggcggcggcgtcccactccaagcttggatgggaccgttttgtgggcggggtggtccgacggctggccgcgcgccgcccgggcctggtctttatgctctggggcgcccatgcccagaacgcgatcaggcccgaccctcgccaacactacgtcctcaagttttctcacccgtcgcccctctccaaggtcccgtttgggacgtgccagcatttcctcgccgcgaatcgctacctcgaaacccgggacattatgccgatcgactggtcggtataagatgccgacatccggggtcttgatttacgagggggcaattaataaagactgttgatggttaaatctcgggtctcataccggtccgtgatgtcgggcgtgggggaagagagggtcccctctgcgtttactatccttgcctcgtggggctggacgtttgcaccccagaaccatgatcctggcgcgtcgccgaatacgacgcccatagagtcgattgcggggaccgcaccggacgcgcacgtggggcctctcgacggagagccggaccgggatgcgatctccccgcttacgtcgagcgtggccggcgacccgccgggggcggacggcccctacgtcacctttgatactctgtttatggtatcttcgatcgacgaactggggcgccgccagctcacggatacgatccgtaaggacctgcggctgtcgctggccaagttcagcatcgcgtgtaccaagacctcgtcgttttcggggacggccgcgcgccagcgcaagcgcggagcaccgccgcaacgcacatgcgtaccacgcagcaacaagagcctccagatgttcgttttgtgcaagcgcgccaacgccgcgcaggtgcgcgagcagctgcgggcggttattcggtcgcgcaagccgcgcaagtattacacgcggtcctcggatgggcggctctgcccggccgtccccgtgtttgtacacgagtttgtttcgtccgaacccatgcgcctccatcgagataacgtcatgctgtctacggaaccagactaagcacccccgccgtcccctttcttttccccctacccttccccccgttactgatgtgttgtgacgtttcaataaataacacgtagcttattttgttggatgatggattgattgattttattgaccgttcgttcgcccggcggtgccgtcgccgcgcgcagagggaatatgcaagcgggcggggtggggaggaaagaaggtttcaggttccgggggttgggtctgcgtcgtccagggtggggctgatctgaatttcccgcagaacctcgaccagtaggtctgttgtgtttgctgggaactcgcccgccgttggggatacgggggcggggggtgtggtcgggcggacgtccaggggtgcgttatcgcacccccgcgccgcctcgggggccgtcccgtagatcgttgcggtgatgtagatggtgtccggggtccacaccaccgtcaggatgccggccgtcgcactccggacgctttcgccgtgcgatgagctgacccaggagtcaaaggggtacgcgtacatatgggcgtcccaccagcgctccagcctctgggtactagcgcgtcctataaagcggtatgcgcaaaattcggcacgacagtcgataatcaccagcagcccgatgggggtgtgttgtatcaccacgcctccgcggggcaggcggtcctggcgcgctcgaccccgcgtcagaaccgcgcgcgtccctgactcaaacacgtgcaccacctgtgccgcgtccggcagcgcgctcgttagcgacgccctggggtgatgtaggctgtacgcgatggtcgtctgggggttccccatgtctcgggggggtgggggtgaatgtcacccggcccgggtgcggtgggaacgcgagggaatggagggttaatagacaatgaccacattcggatcgcgtagagcagatagtatgtgctcgctaatgacgtcatcgcgttcgtggcgctcccggagcgggtttagattcatgtgcaggaactcggatgaggtggtgcgggacatggctacgtacgcgctgtttaggcgcaggtttccgggcgtgaagcatatggcgaccttgtccagactgagcccctgggagcgcgtgatggtcatcgcgagtttggagctgatgccgtagtcggcgttgatggccatggccagctccgtggagtcgatcgactcgacaaactcactgatgttggtattgacgacagacatgaagccgtgctggtcccgcaggacgatgtagggcaggggggactcctccaagaactcggccacgccggccgtcgcgtgccgccgccgcagctcctccgcgaacgcgaacacccgggtgtacgtgtaccccatcagcgtgtagttgtccgtctgcagggccacggacatcagccccccgcgcggcgagccggtcagcagctcgcagccccggaaaatgacattgtccacgtaggtgctgaagggggcgctctcaaacacctccccgaagagctcccgtaggataaggtatcgccccagaaaggccctcttcaggagcccaaactgggcgtggacggccgcggtggtctcaggctcttcgagggcgtagtggcagtagaacacgtccagctgctgttcgtccagcccggcgaagataacgtcaaggtcgtcgtcggggaagtcgtccgggcccccgtcccgcgggcccaggtgcttaaaattgaacgcacgctcccccggagagcggtcgctggtgtcggcggccctggttgccgatgcgccggcggcgtcccggcgtagcgacaggagttctgccgtcagctcccctaggcggccgtaggccagggtcctctgggtcgcgtccaggccggggcgctggagaaagttgtaaaagtgaatcagcccgccgaacatgagccgcgacaggaaccggtaggcgaactccaccgaggtctccccctgggtcttcacgaagctgtcgtcgcgcagcacagcctcgaaggtccgaaacgtcccgtcgaacccaaacaccatctttcggaggcgcgcggtcaccgcgacctggctgttgaggacgtacgtgatgtcgttccgggccacgactagctgttgcttgctgtgcacctcacagcgcacgtgccccgcgtcctggtcctgactctgggagtagttggtgatgcgactggcgttggccgtgatccacttttccatggtcagcgtgggttgctgcgtgagccgtcgatactcgtcaaactctttgaccgacacaaacgtgagcacggggagggtaaacacaacaaactccccctcgcgagtcacctttaggtaggcgtggagcttggccatgtacgcgctgacctccttgtgggacgagaacagccgcgtccaccccggaaggttggccgggttggtgatgtaactttccgggacgacaaagcggtccacaaactgcatgtgctcctcggtgatgggaaggccgtactccagcaccttcatgaggttcccgaactcgtgctccacacatcgcttgttgttaatgaaaatggcccagctgtgcgagaggcgcgtgtactcgcgtagggtgcggttgcagatgaggtacgtgagcacgttttcgctctgccggacggagcatcgcagtttttggtgttcgaaggtggactccagcgaggccgtctgggtcggcgaccccacgcacaccagcaccggccgcaggcggcccgcgtactggggggtgtggtacagggcgttaatcatccaccagcaatacaccacggtcgtgagtaggtgccgccccaggagcccggcctcgtcgatgacgataatgttgctgcgggtgaaagccggcagcgccccgtgtgtgaccgaggccaggcgcgtgagggcaccctggcccagccccaaagtctgctctagggcggtgagggcgtggaactcgtttcgcgcgtcttcgcccccgtgcgccgccagggcccgcttggtgatgtcgaggatcacctcccagtagtacgtcaggtctcgccgctgcaggtcttccagcgaggcggggctgctggccagggtgtacgggtgctgccccagctgggcctggacgtgattcccgcgaaacccgaactcgtgaaagatggtgttgatgggtcgactcagaaacgcccccgagagcttaacgtacatgttctgcgccgcgattcgcgtggcgcccgtgaccacgcagtccaggacctcgttgagggtctgcacgcacgtactctttccggatccggcgttgccggtgatgagatacgccgcgaacggaaactcccggagcggcaggccggtcgggacctccaaggccgccacgtcccggaaccactgcaggcgcggcacctgcgtgacgtcgagctgctgctgcgagagctctcggatgcgtgcgatgattggttggaccccgtgcatggacgtaaaatttaaaaacgcctcgtccctgaaccgcacggcgggtctggccccgggctgctgtgggggcggacctggtgcccggacgtcccgcgagccctccccgccggacgccgccatggccgcacagcgcgcgcgggcgccggcgatgcggacgcggggcggcgacgcggcgctatgcgcccccgaggacggctgggtgaaggttcaccccacccccgggacgatgttgttccgcgagattctcctcgggcagatggggtacaccgagggtcagggggtgtacaacgtcgtccggtccagcgaggccgccacccgacagctgcaggcggcgatcttccacgcgctcctcaacgccacgacgtaccgggacctggaggaggactggcgccgccacgtggtggcccgcggcctccagccgcagcggctggttcgcaggtaccggaacgcccgggagggcgatatcgccggggtggccgagcgggtgttcgacacgtggcgatgcacgctcaggacgacgctgctggactttgcccacggggtggtagactgctttgcgccgggcggcccaagcggaccgaccagcttccccaaatatatcgactggctgacgtgtctggggctggttcccatattgcgcaagacgcgcgagggggaggcgacgcagcgcctgggggcgtttctcaggcagcacacgctgccccggcagctggccacggtcgccggggccgcggagcgcgccggcccggggcttctggatctggccgtcgcgttcgactccacgcgcatggcggaatacgaccgcgtgcacatctactacaaccatcgccggggggagtggctggtgcgcgacccggtcagcgggcagcgcggcgagtgcctggtgctgtgcccccccctgtggaccggcgaccgcctggtcttcgattcgcccgttcagcggctgtgccccgagatcgtcgcgtgccacgccctccgggaacacgcgcacatctgccgtctgcgcaacaccgcgtccgtcaaggtgctgttggggcgcaagagcgacagcgagcgcggggtggctggcgccgcgcgggtcgtcaataaggcgctgggggaggatgacgagacgaaggccggctcggccgcctcgcgtctcgtgcggctcatcatcaacatgaagggcatgcgccacgtgggcgacatcaacgacacggtacgcgcctacttggacgaggcgggggggcacctgatcgacacccccgccgtcgaccacaccctccctgggttcggcaagggcggcaccggccgcgggtcggcgccccaggacccgggggcgcgaccgcagcagcttcgccaggcgtttcagacggccgtggtcaacaacatcaacggcatgctggagggctatatcaataatctctttggaaccatagaacgcctgcgagagacgaacgcgggtctggcgacccagctgcaggcgcgcgaccgcgagctgcggcgcgcccaggcgggggcgctggagcgggagcagcgcgcggcggaccgggcggccgggggaggcgcgggccgcccggcggaggcggatcttctccgggccgactacgacattatcgacgtcagcaagtccatggacgacgacacgtacgtggccaacagtttccagcaccagtacatccccgcgtacggccaggacctcgagcgcctgtcgcgcctctgggagcacgagctggtgcgctgcttcaagattctgcgccaccgcaacaaccagggccaggaaacgtcgatctcgtactctagcggggcgatcgcctccttcgtggccccgtatttcgagtacgtgcttcgcgccccccgagcgggcgcgctcatcaccggctccgatgtcatcctaggggaggaggagttatgggaggcggtctttaagaaaacccgcctgcagacgtacctgacagacgtcgcggccctgttcgtggcggacgtacagcacgcggctctgccccggcccccctccccaacccccgccgatttccgggcgagcgcgtccccgcggggcgggtcccggtcccggacccggacccgatcccggtcgcccgggagaacgccgaggggtgcgccggaccagggctggggcgtcgaacgcagggatggccgaccccacgcccgccgatgagggaacggccgccgccatcctcaaacaggccatcgccggggaccgcagtctggtcgaggtggcggaggggatcagcaaccaggcgctgctgcgcatggcctgcgaggtgcgccaggtcagcgatcgccagccgcggtttaccgcgaccagcgtcctgcgcgttgacgtcacccccagggggcggttgcggttcgttctggacgggagttccgacgacgcgtacgtggcgtcggaggattactttaagcgctgcggggaccagccgacgtatcgcggttttgcggtcgtcgtcctcacggccaacgaggaccacgtgcacagcctggccgtgccccccctcgttctgctgcaccggctctccttgtttcgccccacggacctccgggacttcgagctcgtctgcctgctgatgtacctggagaactgtccccggagccacgccacgccctcgctgttcgtcaaggtgtcggcgtggttgggggtcgtggcccgccacgcgtctcccttcgagcgcgtccgctgccttctcctccgcagctgccactggatcctgaacacgctaatgtgcatggcgggcgtgaagcccttcgacgacgagctagtcctgccccactggtacatggcccactacctgctggccaacaatccgccccccgtcctctcggccctgttttgcgccaccccgcagagctctgcgttgcagttgcccgggcccgtcccccgcacggactgtgtggcctataacccggccggcgtcatgggaagctgctggaattccaaggacctgcgttcggctctggtgtattggtggctttcggggagccccaaacgacggacctcgtcgcttttctatcggttttgctaactccggaaaataaacgtgttttttatggaacgttccccacctgtcgtgtcatctctcgggggatggtggtgggcctgtgtgtgtgtcttgtgcaccgaaggaggaaagtgggggggtggtggtgctggtggtggaaagacatgatagagggaacaaagaaatagaagaaaaccacaaccggcgcgtgccagtaaatacggacgcgcgcacacgcggggggtaagttggagcacggggccccggtttattgaccaaattcagggaaacagaaaccgcatcttttcctcgaaagggtacacaaagctcccgccctcgccccacacgccttccagaacccccgtaaacaccagttgaatctcgcgcaggatctcgcgcaggtgatgggcgcagtccacgggggggagcaccaagggccgcgggtacagatccacggggacgccgaccgactccccgcccccgggacatacgcgcacgacgcgtctccagtattgctccgcgtccagcagggcgcctccgcggaaggccgtttggggcagggggtcgtcggcctcgcctgggggggtcagaacgctccagtactccgcgtccagacgcctcccgaaggcatccaggacaaagcggtcacaggcgtcctccatgacgccccgggccgcgcacacggcctcctccggcgggccggcggccggccgccggaggattcgtctcagcgcgtcgcgcataacctcggccgccgcggcgtacgcgggcccgcggagaggaaatccctgcaggaagtcggtgtcatcgcgggagttccagaaccacgccccggtctggctccaggtgacgacgtgggtgtagacgccctctggcgccagggagggggcgaggcgcgggcgtatgccgttggccgaaagtacggcgcgcacggacgcctcgagggcccggcgggcgtcctggatcgcgccgtgcgcggcgtccgcgtccccggggtccacgttgaacagcccccagaacgcagccccggtgccgccgcagaccgcaaacttcaccgagctggccgtctgctcgatctgcaggcagacggcggccatgaccccgccgagcagctgccggagcgcggggcaggcgtcgcacgcgtccggcaccaggcgctccagcacggcccgggcccagggctccgagggggcggccgccaccagcgcgtccagcctttccaggcccgcccgcccccgggcttccggcagcccggcctccccgaggcccgcgagggcggccaggagctgggcctggagcccggagaaacaaaaccgcgccgtccagaccggcccgacggccgccggggggtcgagtagttggatggtggtggccgtggggtgccaccgcgccaccgcttcccgaaaggcgggcaggaggcggccggccgcctccgaggccacggccggccatgcccgcgggggcaggacgaccctggcgcccaccgcgggccaggcccccaggcacgcggcatgggtggccgcggcgccccgcaccaggtcacgcgccgactcggcggcggcggcggccggcacggtaaacgtgggccagcccggaaatcccagcacggcaaagtattggacgggccctccccggacctcaaacccgggccccagaaaagcgaagacgggggccagggctccgggggcggcgtggaccgtggtatgccactgccggaagagggcgaccagcgccggggcggagaacccgtcgccggcgctcacgaagtagtcgtagccgcgcggcagcagcacccgcgccgtgacccgctgcgggtgtccgcggggccgcaggccgacctcgcacacctcgaccaggtccgcgaaggcgccctccttcctggtcggcggaaacgccagggtggtgtattcgcgcgcaaaacgcgcggtcctcgtcgtgatggtgacggcgagcgaggcggaggacgcgcactgggggctgtcgcgaatggcggccaggcgcgcccacgccaaccgcgcgccggggtgctcggcgacgcgcgcggacagggccagcgggtcgacgtcgaccttggcctccacgtccaggagggcggcgcgaggagcggccggcgggccccacgacgccctttcgaccctcacgaccagacccgtctgcgggtcccagcccaggcgcagcgggacgaagagggccaccggccccgtctggcgctccagggccgccagaacgcacgcatacagcgcccgccacagggtcgggtcccccaggggctccagcggggaggcggccggggccgtcgcggcgcgggcggccgcgacggccccggcggccgagacgtcgggggagccgtagaagtcctgcaggtcggacgaaccaacggacacctccgcgaagcgcgcgcgcgcctcccccgcggcgtcgcgacagaccagatacagcagggcgtggaggcagtcgcgcgtgcgcgggggcagccataccgcgtatagggtaatggcgctgacgctctcctccacccaaacgatgccgggggcttccatgccacgacgcccgggggttgccgtgtatcgaacgagcgcggccccagacttatagggtgctaaagttcaccgccccctgcatcatgggccaggcctcggtgggaagctccgacagagccgcctcgagaatgatgtcagtgttgggctgggcgccggaggcgtgcgtgcgcaagcagcgcccccacgcgggcgcgcgcagcttgaagcgcgcgcccgcaaactcccgcttatgggccatcagcagcgcgtacagctgtctgtgcgtccggcaggcgctgtggtcgatgcggtgggcgtccagcagctccacgatggctcgcttggtgaggtttttaacgcgccccgccccgggaaacgtctgcgtgctcttggccagctgcaccccgaacagttcgccccagatgatcttgaacagcgacagcgcgtgctccgtctcgctcacggacccgcgcggggggcagccgctcagggcgtcggccacgcgcttaaccgcgtcctccgacagcaaggggccgtcggtcacgttacagtggcccagttcgaacaccagctgcatgtagcggtcgtagtgggggttcagcagctccagcacgtcctcggggctaaaggttcgccccgaccccccggccatcgagtcccactgcaggcacgcggccatggtgctgcacagacggaacagctcccagacgggggcgacgtttagggtggggtgtagggccacaagctccagctctccggcggcgttgatcgtggggatgacgcccgtggcgtagtggtcgtaaagccgccggaagatggcgctgctatgggcggccatggggacgcgaagacaggcctccagcagcaccaggtagatgaaccgcgtgcggccgaccaggctgttgaggccgcgcatgagcgcgaccacctcggccggcgcgacgtccggccggaggtacttttcgacgaaaaggcccacctcctccgtctcggcggcctgggccgacagggacgtgtcggggtcctggcagcgcagctcccgcagatcccgctgggccctcagggcatcaaaatgtatcccccgcaaaaacagacaaaagttcctcggggtcagcgcggcgtcgtggccccagaaccgcacgtgcatgcagttgagggtcagaagcatgtggaggatgttaagactgtccgcgaggcacgccagcgtgcacctctcgaagtagtgcttgtaccggaatttgctgtagatgcgcgacccccgcgcctgcgccgcgtcggcgtgcgacgcgtcgcagcgccctttgaaccggcggcacaacaggttcgtcacctgggaaaactgtgccggccactgcccgctggcgctcaccacgtggttgagcagcatgggcgtaaagacgggctccgagcgcgccccggacccgtccatgtagatcagcagctcccccttgcggagagtccgtacccgccccagcgactggtacacggacaccatgtccggcccgtagttcatgggtttcacgtaggcgaacatgctgtcaaagtgcggcggatcgaagctaaggcccaccgtcacgaccgttgtgtagatgaccacccggtaccggccccatgtggtcacgtcgccgggcggggtgagcgagtggagcagcagcacgcggtccgtaaactgccggcagaacctggcaacgacctccgcgaaggagaccgtcgacgagaagatgcagacgttatctccgccggccaggcgcgcctccagctccccgaagaaggtggcgtccgggggggcgtccggggggggcgccccgcccgccggccccggcgggcgcagggccgcctgcaggacctcgggccccaggcgcgggagaaacagacaacggcgcgccgaaaatccgggcatggcgtactccccgatgaccacgtgaacgttcttttcgccccggaggctgcacagaaagtccaccagctgcgcgttggcggtggcgtccatggcgatgatccgcgggcacgtgcgcagcaggcgcagcatcaacgcgtcgacgcggcccagctgctgcatcgtcggcgagtacagttggcccaacgtcgacatgacttcgtccaggacgagcacgtcgtagttgttcaacaggttcgggcccacgcgatgaagactttccacctgcacgatgagacggtggaaggggcggtcgttcatgatgtaattggtggatgagaagtaggtgacgaagtcgggcaaccctgactcagcgaaccgcgtcgccagggtctgagtaaaactccgacgacaggagacgaccagcacactcgtgtccggagagtggatcgcttcccccaaccagcggatcagcgcggtagtttttcccgagcccattggcgcgcggaccacagttacgcaccgggccgtcggggcgctcgcgtccgggaaggtgacgggtccgtgttgctgccgctcgatcgttgttttcgggtggacccggggaacccactcggccaaatcccccccgtaaagcatccgcgccagcgatacactcgacgtgtactgctcgcactcgtcatccccgatgggacgccgggcccccaggggatcccccgaggccgcgccgggcgccgacgtcgcgcccggggcgcgggcggcgtggtgggtctggtgtgtgcaggtggcgacgttcatcgtctcggccatctgcgtcgtggggctcctggtgctggcctctgtgttccgggacaggtttccctgcctttacgcccccgcgacctcttatgcgaaggcgaacgccacggtcgaggtgcgcgggggtgtagccgtccccctccggttggacacgcagagcctgctggccacgtacgcaattacgtctacgctgttgctggcggcggccgtgtacgccgcggtgggcgcggtgacctcgcgctacgagcgcgcgctggatgcggcccgtcgcctggcggcggcccgtatggcgatgccacacgccacgctaatcgccggaaacgtctgcgcgtggctgttgcagatcacagtcctgctgctggcccaccgcatcagccagctggcccaccttatctacgtcctgcactttgcgtgcctcgtgtatctcgcggcccatttttgcaccaggggggtcctgagcgggacgtacctgcgtcaggttcacggcctgattgacccggcgccgacgcaccatcgtatcgtcggtccggtgcgggcagtaatgacaaacgccttattactgggcaccctcctgtgcacggccgccgccgcggtctcgttgaacacgatcgccgccctgaacttcaacttttccgccccgagcatgctcatctgcctgacgacgctgttcgccctgcttgtcgtgtcgctgttgttggtggtcgagggggtgctgtgtcactacgtgcgcgtgttggtgggcccccacctcggggccatcgccgccaccggcatcgtcggcctggcctgcgagcactaccacaccggtggctactacgtggtggagcagcagtggccgggggcccagacgggagtccgcgtcgccctggcgctcgtcgccgcctttgccctcgccatggccgtgcttcggtgcacgcgcgcctacctgtatcaccggcgacaccacactaaatttttcgtgcgcatgcgcgacacccggcaccgcgcccattcggcgcttcgacgcgtacgcagctccatgcgcggttctaggcgtggcgggccgcccggagacccgggctacgcggaaaccccctacgcgagcgtgtcccaccacgccgagatcgaccggtatggggattccgacggggacccgatctacgacgaagtggcccccgaccacgaggccgagctctacgcccgagtgcaacgccccgggcctgtgcccgacgccgagcccatttacgacaccgtggaggggtatgcgccaaggtccgcgggggagccggtgtacagcaccgttcggcgatggtagccgtttcgttcgttttaataaaccgacgttgtgcgtttcaccatacttcggcgcgcgtgtgtgtgtgtttttttttttgtggtgtttattttccccccaccccttccttttctttcggccaccacccccctcctcccccgtactatacaacaaaaaataccacacatacgaccaaatacggacaatcatttctgtctttattcgctatcagagagtgggggcgtgagcgtggcaggagggcgggccacgtcggggtcccgccgtctggtgtgacgcgatggggggtccgatgcgcgccggtactggggccccggcgcccgggtgaccacgcgcacgtcggggggcacgtagaagttaccctcttcttcggactcgatgtccacgacgtcaaattcgtgggcggtcagcgagacgacctccccgccgtcggtggtgatgacgttgtgtcggcagcagcagggccgcgccccggagaacgcgaggcccataacttggcgagcgtatcgtcgaaggccaggcggctgtttcgccggatgtcccggtagatccccggctcgacgcggacgggggtgatgatcagggcgatcggaacggcctggtccgggaggatcgatgccttggcgggtccgggggccccgccacgcccggcgggcgctccgcggccgtcctccaggcggaacgtcacgccctcctccgcgcccgcgcggtgcctgccgaggaacgtcaccaggtgcggttgcagggggcagtcgggaaagtggctgtcgaggacgtatccctgcaccaagatctgtttgaagttcgggtggcgggggttggcgaagatgggctcgcggcgaaccagctccccggagctccaggccacgggagagatggtgcgacgctcaaggtcggggacgccaaacagaagcacctccgagacaacgccgctatttaactccaccagcgcccgatccggggcggagcatcgccttttttcgccggcggcgcgggaatcgagccagtcccggtcttgggtgacgagcgcctcctccgggcccggaacgcgcccgggcgcgaagtagcgcacgccggggttggggatggaccggatgaacgcccggaacgcctccggcgatcgccgcgccatcaggtcctcgtacgcggaggccgcgggggcgccggggtccgcggggtcgaacgcgtacttggctcggcacttaacctcgtagaaggccaggggggtctggggggcgggggccaggtagccgtgagggtccctggggcacacgaggatgtccagggacgcccccaccatgcccgtgtggccgtccatgaggaccccgcacgcgtgcacgttctcctcggcgaggtccccgggttggtgaaagacgaagcgcccggcgtcggcgtcgtcgttgacgcccgcgtccgcgcggcccacgcagtagcgaaacagcaggtttcgggccgtcggctcgttcacccgcccgaacatcaccgccgacgactgggcgtccagccgcaggctggcgttgtgggtgagccactgggacgagaagcacggaccctgcgcgccccaccgcagcgtggaggcggtcgtcaggccccgccgaagcagggcccagagctggcagtcggcctggttttgcgtcgccgcctcgtaaaatcccataagcgggcggggggcgacggcttcggcggcggacgggggggcgcggcgcgtcaggcgccagaggtgccggccgagcccgcggtccaccatgccggccgcctccagcgacacgacgagggagcacagatagtccaggcgagcccacaggggcccgatggccagaggggagcggacgccgcgcagcaggccgcgcaggtggcgctcgaacgtttccgccaagatatgggggggcagtgcgttggggatcgccgacgccgaccacatcgggtcggggtccgggggaccggggctgcagtccgggtcgatggcgtgtgcgccccccggcgagaggggaatgtcgggggttggcgggccggatgaggcctcagagagggccggggacgcgggccgggccttttcgcccggggccccgccgtcgggttgcccacgtggggggctctggggccaatgggaacccggggcccccggtgacgtggggcggggtggggcggggcggggcccaaagacggtcgccagatctaggctgttgggtcggggccgcttcgggggactatcggggtcgcgggcggggtccgcggggcgcttggcgccgggtgttgcggcggccgccatttttacgagcagccgaagagctcgagggcggaagggatcctcacgacagagagtggcgcgcggccgggttggcgtgacagaggcgggagaccagcaccagcagcggcctcagctcgggcggcagcgacaccgacgacaggacggccttgtgcgtgcgctggtaatttatacactgctccgtgaacgcgcgccgaatcttgggattgcgaaggtggcgccggatgccctccggcacgtcatacgccaggccgtgggtgttggtctcggccgagttgacaaagagggcggggtgcagaacgcagcgataggcgaggagggccacggcaaagtccggcgagagctggttgttaaagtactggtagcccgggacgcgggtcacggggacgcccaggctcggggccacgtacacgctaaccagcagctccagcagcgtctgccccagggcgtagagatcgaccgccagcccgacgtcgtgcttcagggggcggttgttaaactcggcccgctcgttgttgaggtactttaccgagagctccggtggctggttgtacccgtgccccaccagagtgtgaaagttggccgtggtcagggcggcgggcatcccaaacccccggggggactcgaggtccggctcctggaggcaaaactggccccgggatatcgtggagttggagttcagggtcaccaggctaaagtcggccaggacggcccgccggagcgacaccgcgtccgatcgcagcatcacgaggacgttggcgcacttgatgtccaggtggctgatcccgcacctggtgttcaggaacaccacggcgcgcgccaggtctgtgaagcagtggtggagggccgtcgcgacggagggggtggtcgcgcgcagggacgccagctggccgatgtacttgccgaggtccatgtcgtacgcggggaacacgatctggcgctgctgcagcgagaacccgagcggggtgataaagccgcggatgtcgtgggtgcggccgccgcgaagagcgcactcccccacgagcagggtcgcgacgagctccacggcaaaccactctttttcccggatggtcttcacggcgagcttgtgttcgcgaatcaactgcacctcgccgtacccccccgagcccccgaagctgcgggccccggggatctccagggtcgtgtagcggagggcggggttgacggcgaatacggggatgcatagcttgtggatgcgcgcgagggacaggatgtgcgaggggggcgacgggggcgaggtcatggccgtctcggacctgcgcaggggcgggcgccttagcttggccgcagggccgggggcctcgggggacgagcggcgacgagacgagcggctcactcgccatcgggacagtcccgcgcgaagccgctcccggaagctggatcggcggcgggacccggggcgggctccggagacggcgccgtctcggggggaggggccgcttgggcgtccggacgcccggcggctgagggagtgtatgtaggacgcgagccaggccttgaaggagcgtcggtgtgcaccttgggggctgatgtcagctgccacatgactagcaggtcgctgtcgcccggactcatccatccgtccgccaggtcgccgtccccccacagagacgcgttcgccgcggcctcttcgagctgctcctcctggtccgcaagacgatcgtccgccgcgtccaggcgctcgctaagcgcgggatcgaggtaccgtcggtgtgcggttagaaaatcacgtcgcgccgcttgctcttccacgcgaattttaacacaggtcgctcgctgtcgcatcatctctaagcgcgcgcgggactttagccgcgcctccaattccaagtgggccgccttggcggccataaaggcgccaacaaacctaggatcttgtgtactcacgccctcccggtgtagctgcagggtctggtccctgtacacctcggcccggaggtgcgtctcggccaaacgtcggcgcagggccgcgtggctggcgtctcggctcatctcgccgcccccgcgcgcgcccgacgtcggactccttcgccccgacccccctgacctcagccgcccccgcctcgcccgcgatgtttggccagcagctggcgtccgacgtgcagcagtacctggagcgcctggagaaacagaggcaacagaaggtgggcgtcgacgaggcgtcggcgggcctgacgctcggcggcgatgcgctgcgcgtcccttttttggattttgccaccgcgacgcccaagcgccaccagaccgtggtcccgggcgtcgggacgctccacgactgctgcgagcactcgccgctcttctcggccgtcgcgcggcggttgctgtttaatagcctggtgccggcgcaactcagggggcgtgactttgggggcgaccacacggccaagctggagttcctggcccccgagctggtgcgggcggtggcgcgcctgcggtttcgggagtgcgcgccggaggacgccgtgccccaacgcaacgcctactacagcgtcctgaacacgtttcaggccctgcaccgctccgaagcctttcggcagttggttcacttcgtgcgggacttcgcccagttgttgaaaacctcgttccgggcctctagtctcgcggagactacgggccccccgaagaaacgggccaaggtggacgtggccacccacgggcagacgtacggcaccttggagctcttccagaaaatgatactaatgcacgcgacctactttctggccgccgtgctgctcggggaccacgcggagcaggtcaacacgttcctgcggctcgtgttcgagatccccctgtttagcgacacggccgtgcggcacttccgccagcgcgccaccgtgtttctagtccccaggcgccacggaaagacctggtttttggtgcccctcatcgcgctgtcgctcgcgtccttccgggggatcaagataggctacacggcccacatccgcaaggcgaccgagcccgtgtttgatgagatcgacgcctgcctgcggggctggtttggctcgtcccgggtggaccacgtcaagggggaaaccatctcgttctcgttcccggacggctcgcgcagcacgatcgtgtttgcctccagccacaacacgaacgtaagtacgccttcctcccgcggtgcctgtttccccggtgccgccctccccgagatcgaccgacagacaaacacagccagacgcgagtgtgggacgacacgcccgcagccccccccccgccatggcgggggggaagccttactgtttatttgtaatcggacgatgaggctctggccacggcccgcgcgaccgcggggcagctcgttgcaaacaggcggctggtatacgatgacagaacgcagaggcgccacccggcgctggtcgggcggatgacgctttccgcgccgtcccggcccacgacgacctcgtgcaggtgggccgtgatgcgcgggcggcgggtcgcctgccgcaggataaccgcgtccacggggtgcccgaagaggagctgacacaggctcgcgtccccccggacggccagggtgcgctgggccatattggaccacatgcacggggcgacgcagggacaggcctccgccacggcgggggcgcgccacagcgcgttggcggaatcgatgtgggccgtcggggcgcaggcgccgcctcctcccggggggtcggtaatcctggatagcagccatcctaaatggcgggcccggctgcccgggggacagagcgaccccaggtcatcatccatggcccagcagtatatgcggccgccggggaggtgccaccaggcccccggacccagggcacagcacgcccccggattcgggggcggttccgtgggtaccaggtaggcgccgtcgagctcgtgggccacgggctcgtccgcgagctgttcggcggcggggtcgggggtttcctccgggggggaggcagcttccaggtggccgaaggctagggtgcacagcagcggggtccgggggtgcgttacgctgcggaggtggacggtggcgcagtagcggcgctcgcggttaaagaagaaaatggcaaagaacgtgttcgaaggcaggcgcagcgccttgggccgcgtcaggtacaggaagatctcgcagaaaagggcacgctcggggtcggggtccggaagggccacctggcacagcggctcggtgaggaccgtgaggcaccgaaaaatcttaagccgctcgtccccccgaacgacgcgccacacgaagacagagttggcgatgcgcgcgacgaggtcggcttcgggccccgggtcgggggcgcgcgcgtcggggggggcgccccggtgacccggcggggccgcggctcccggggggcctggcgtcgcctggggacgccagagtgcccgctgtgccaggttggtggtggggaagggaccggagacgcaccaaaagcagaggggccagcgcgtgtatgagttggggggggggtgggtgagcggtggaacaaaagcacgcgtcagcggacaaggccgggtcccgtagccgccccgcgacagaaccggagtccgacggcacgcgcgacggggtctgcgaggctgaggtacgccgcggtgttaatggtaaacgcaaagcctcccggaaagaccactagcccgcagaggcggcgattgaacccaaggcagaggtacgcgtagctctctcccggaaggtattgctcgcagaccctgtgtggggcagtggaggggctgccctccatgaagcgacatttactctgctcgcgtccattgacgtcaccgtcaatcaccactgcgattggacggttggtgaggcgcagcgtgtctccgctggtgctgtagtagtcaaacgcgtagtgggcgtcggagtcggcgaagcgggcggggatgtcgtcgctgagagggacgagccgccgccgccgcccccgaccgccctggccgcccagatgcgccagcacggccagggcgtacgcggtgtgaaagaacgcgtcgggggcggtcccctcgagggcgcgcatcaggttctccaggagcacggggaagcgccgcgtcacctcccctagccactcgctctggtgggggccaaagtcgtagcgcaggcgctggaagatgcgcgggccgccttggagcgcggcccggatagagtggcccagggcccgcagacacgcgatctggatgcgcgcgacgaaggccacctcggccgcgatgtcaaagggctgcagcacggggcgcgggtggcgcaggggtccctcgagcgcgggaaagcgacgcagcagcgccgtctgggccgcgggggacagctggtgggggcgcacgacgcgctcggcggcacaggcctccgtcagggccgtggccagctcggaggacagccgcggggggcgggcgcgtcgcccgccccacgccaccgaattctcgtaggagacgacgacgaagcgctgcttggtcccgtagtgatggcgcaggaccacggagatggagcgacggctccacagccagtcgggccggtcgccgccggccagagcttcccacccgcggtccagccactcgaccagcgatcgcggcttggcggtccccggcacgagggtgagcacgtcgttgaggacgtcctcgcccgcggcccgggggccccccggggtggcaaagcgccccccgccgggcggctccaggcccgccagcaccgcctccgcgtccgacgcgcccagggctcccccgctgacggcctggtggaccagggcgccctggcggagccccgaggcgacgccggaggccgcgtgcttggggcgcgcgcggaccgggtggcggcgggtgacgtcctgcacggcccgctggaccagcgcgaggatctcctcgttctcttgcgtgatggacacgtcctccgcggtggccgtgtcgcctcccggggccgtgagctgctcctccggggagatgggggggtctggggtgccgacaacggccggcccggccccgcccgagaccgaggacgcctggggagtgggggtgccgctttcccccatccccagggacaggtgggccgccgcctccgtcgcggcggcgggagccgcggcccccagccgcgcgacgtagcgacaaaagtggcgacagaggcgcatgaggcgcgcgccgtcggccgcgtatcgcgtgtttggcgggacgagctcgtcgtaactgaacaggagcacgcgggcgcaggtcgcccacgggccccacgccaggcgcagcgccgcgaccgtgtacgggtcgtacacgccttgggcgtcgcacgcgaccggcagggagacgaacagcccgcccgcgctggggacgcgcggcaggaggtccgggtgcgccgggatgacgggggctaggatcgcccccaccgcatccgccggcacgtaggcggcaaacgccgaacgccacggggtgcagtcgccggtcgcgtgggcccgggtctgggtttcgacccggaagttcgcggccgccccaccgtcggggcggccgcgcacgagggcggacagcgggacccccgccgccgccaggcactcgctggagatgatgacgtgaatcagcgaggcggggctgctcgggtcccgggtgagatcgtattggacctcgttggcaaagtgcgcgttcatggcccggccggcggtgcgagcccttcccggtgccggaaggggcgtgggtggggggtgcgtgtgcgcgtcctcggggcccgcgggcgcacgtgcgcttatacgctgtgtgtttcgtctgtccccagggaatccggggccaggactttaacctgcttttcgtcgacgaggccaactttattcgcccggatgcggtccagacgattatgggctttctcaatcaggccaactgcaagatcatcttcgtctcgtcgaccaacaccgggaaggccagcacgagctttttgtacaacctccgcggggccgccgacgagctgctcaacgtggtcacctatatatgcgacgaccacatgccgcgggtggtgacgcacaccaacgccacggcctgttcctgctatatcctgaacaaacccgtgtttatcacgatggacggcgccgttcgccggacggccgatctgtttctgcccgactccttcatgcaggagatcatcggggggcaggcccgcgagaccggcgacgaccggcccgtcctaacaaagtcggcgggggagcggtttctgctgtaccgcccctccaccaccaccaacagcggcctgatggcccccgagctgtacgtgtacgtggacccggcgttcacggccaacacgcgcgcctccggcaccggcatcgcggtcgtcgggaggtaccgcgacgatttcattatcttcgccctggagcactttttcctccgcgcgctcacgggatcggcccccgcggacatcgcccgctgcgtcgtgcacagcctcgcccaggtgctggcgctgcaccccggggcgtttcgcagcgttcgcgtggcggtcgagggcaacagcagccaggactcggccgtggccatcgccacacacgtgcataccgagatgcaccgcatcctggcctcggcgggggccaacggcccggggcccgagctcctcttctatcactgcgagccgcccggcggcgcggtattgtaccccttctttctgctcaacaaacagaagacgcccgccttcgaatactttatcaaaaagttcaactccgggggcgtcatggcgtcccaggagctcgtctccgtgacggtgcgcctgcagaccgacccggtcgagtatctgtccgagcagctcaacaacctcatcgaaaccgtctctcccaacaccgacgtccgcatgtactccggaaaacgcaacggtgccgcggacgacctcatggtcgcggtcatcatggccatttacctggcggccccgaccgggatccccccggccttttttccgatcacgcgcacgtcttgagtctttcttgccgtttcttttgtttctctttctttccccccctctctccgcaataaacgccttcccggaactgtgtttccccccctacaacagtgttgtccgttggttgggtggttggggtgcgggggtgggcgggggaagcaagaaaacggtcggcgaacacaacatcgggaaaacggattcccgcacgtgcgtcttcccagattcgacacacacaccccccttctccttaaataaacacaaaccacacgctcgttggttggttaatgccagcgctttatttacgtcttgttttttttgcgtttcctccgcgggtcccttcccaacacgcctgcccccgcctcaggggtagcggataaccggggccatgtcgccggattgcacaacggcggcgccgtcgaacgtacacacccgaaccgccggggccagggccaggatgtccccgagttggcccgcgtgcgccagccaggcgaccagcgcctcgtaaagcggcagcctgcgttcgccgtcctgcatcagcatgggggcttcggggtggatgagctgggcggcttctcgcgtgacgctctgcatctgcaggagcgcgttcacgtatccgtcctgggcgctcagcgcgagcagccgggggatgagcgtgaggatgagggtggttccttcggttatggagtagaccatgttgaggacgagcgaccgcagctcggtgtttacggaggcgagttgctggacgtcggccacgagcgagagacgggccccgttgtaatacagcacgttgaggtcggggagctccccgggcgtccgggggtcggggttgaggtcccggatgccccgggcgaccagccgcgcgactatctcgcgggccaggggcgttgggagcgggaccggaaaccgcagcgtgaggtccagcgactccaggcgcacgtccgtcgcctggccctcgaagacgggcgggacgaggctgacgggatccccgttgcagaggtcgacgggggaggtgttgcggagattgacggtgccggcgtgcgtgagccccaggtccacggggcaggcgacgattcgcgtgggcagcacccgcgtgattaccgcggggaagcgcctgcggtacgccagcaacaaccccaacgtgtcgggactaactcctccggagacgaacgattcgtgcgccacgtccgcgagcgccagctggcggcggatggtcggcagaaagaccactcgaccctcgcaccgctgcagcgccgcggcatcggggcgcgagatacccgaggggatcgcgatgtctgcttcgaaacaatccgtgatcatggcgccgggccgcgagacaccggaacgcgggggtgcgggagggccggaaagcgcaacgcaaccgggacgatgatgaaacagagatggggggcaccgaccgtgtgggagagggggcggggcagggctcagcagcacgcacggggaggtctgtcgtgcgcaggagccccaggtgagaatcagtcccccggagctcgggtctgggttttattgggacctgccctcggaatcgcggctcccagtccaagcccccctggggggggcggggacagggggtgtgtgtgggtaaaagcaacgtcggaaaatcaaacccaatgccccaaacaggaaaaaaaaagacgggcgggtggagggaaagctggggaagaagaagccaattttacagagacaggccctttagcggggaggcgtcgtagatgagatactgcgtaaagtgggtctctcgcgcgtgggcctccccatcgcgggcgctgcgtagcagggcggggtcgctggcgcaggtgatcgggtaggcttcctgaaacaggccgcacgggtcttccacgagctcgcggcaccccggcgggcgcttaaactgcacgtcgctggcagcggtggccgtggataccgccgatcccgtttccacgataagacgctccaggcagcgatgtttggccgtgatgtcggccgcggtgaagaacttgaagcaggggctgaggacgggcgaggccccgttgaggtgataggccccgttgtacagcaggtccccgtacgagaaccgctgcgacgcccacgggttggccgtggccgcgaagggccgcgccgggtcgctctggccgtggtcgtacatgagggctatgacgtccccctccttgtcccccgcgtacacgccgccggccgcgcgtccccgcgggttgcagggccggcgaaagtagttgatgtccgtggccacgggggtggcgatgaactcacacacggcatcctgcccgtggtccatgccggcgcgccgcggcacctgggcgcagccaaagaccgggaggggctgggccggccccagccggtttcccgccacgaccgcgttgcgcaggtacacggcggccgcgttgtctagcagcgggggggccccgcggccgaggtaaaagttttgggggaggttgcccatgtccgtaacggggttgcggacggtggccgtggccgcgacggcggtgtagcccacacccaggtccacgtttccgcgcggctgggtgagcgtgaagttgacccccccgcccgtttcgtggcgggccacctggagctggcccagaaagtacgcctccgacgcgcgctcggaaaacagcacgttctcggtcacgaagcggtcctgccgcacgacggtgaacccgaacccggggtggaggcccgtcttgagctggtgatacagggccacggggctcatcttgaagtaccccgccatgagcgcgtaggtcagcgcgttctcccccgccgcgctctcgcgggcgtgctgcaccacgggctggcggatggaggagaagtagttggcccccagggccggggggaccagggggacgtggcgcgccaggtcgcgcagggccggggggaagttgggcgcgttggccacgtggtcggcgcccgcaaacagcgcgtggacgggcaggacgtagaagtattcgccattttggatggtgtggtccaggtgctggggggccatgagcagcacgccggcgtgcagcgccccgtcgaagatgcgcatgttggccgtcgacgcggtgttggcgcccgcgtcgggcgccgcggagcacagcagcgccgtcgtgcgctcggccatgttgtgcgccagcacctgcagcgtgagcatggcgggcccgtcgacgacgacgcgcccgttgtggaacatggcgttgaccgtgttggccaccagattggcgggatgcagcgggtgggcggggtcggtcacgggatcgctcgggcactcctcaccgggggcgatctccgggaccaccatgttctgcagcgtggcgtacacgcggtcgaagcggacccccgcggtgcagcagcgcccccgcgagaaggccggcaccagcacgtaatagtagattttgtggtggacggtccagtcggccggccggtgcggccggtcgtcggcggcgtcggccgcgcgggcctgggtgttgtgcagcagccggccgtcgttgcggttaaagtcggccgtcgccacgttgcacgccgccgcgtagacgggctcgtgcccccccgcgtcaatccggcagtctcggtggcggtccagggccgcgtgtcgcataaggccgtcgcagtcccacacgaggggcggcagcagcgccgggtcgcgcatcaggtgattcagctcggcctgagcctgcccgcccagctccgggcccggcagggtaaagtcgtccaccagctgggccagggcctcgacgtgggccaccaggtcccgatacacggccatgcactcctcggggaggtcgcccccgaggtaggtcacgatgtacgagaccagcgagtagtcgttcacgaacgccgcgcatcgcgtgttgttccagtagctggtgatgcactgagtcacgagccgcgccagggcgcagaacacgtgctcgctgccgtgaatcgcggcttgcagcaggtaaaacaccgccgggtagctgcggtcctcgaacgccccgcggacggcggctatggtagccggcgccatggcgtggcggccaacgccgagctccaggccccgggcgtcacgaaacgccaccggacacagcgccaggggcaggttgccgttgaccacgcgccaggtggcctggatcgcccccggaccggccggggggacttcgccgccgggaagctcgacgtcggccacgcccgcgaagaagtcgaacgcggggtgcagctccagagccaggttggcgttgtcgggctgcatgaactgctccgcggtcatctggcactcggcgacccaccggacccggccgtgggcgaggcgctgccgccaggcgttcagaaaacgctgctgcatgtccgcgccggggccggccggggccgcgacgtacgccccgtacggattcgcggcctcgacggggtcgtggttcacgcccccgacggccgcgtcgatgttcatgagcgaaggatgacacacggtcccgaccgcgttctccatggacagccgcagaacctggtggtcctttccccaaaaaaacagctgccggggagggaacgcgcggggctccgggtggccgggggcgggcaccaggtccccggcgtgcgcggcgaagcgctccatggccgggttgaacagccccaggggcaggacgaacgtcaggtccatggcgcccaccagggggtagggcacgttggtggcggcgtagatgcgcttctccagggcctccaggaagaccagcctgtcgcctatggccaccagatccgcgcgcacgcgcgttgtctggggggcgctttcgagttcatccagcgtctcccggttcgcctcgagttgctcctcctgcatatccagcaggtggcggcccacgtcgtccaggctccgcacggccttgcccatcaccagcgccgtgacgaggttggccccgttcaagaccatctcgccgtaggtcaccggcacgtcggcctcggtgtcctccaccttcaggaaggactgcaggaggcgctgtttgatggcggcggtggtgaccagcaccccgtcgaccggccgcccgcgcgtgtcggcgtgcgtcaggcggggcacggccacggacggctgcgtcgccgtggtcaggtccacgagccaggcctcgatggcctcgcggcgatggcccgccttgcccaggaagaagctcgtgtcgcaaaagctccgcttcagctcggcgaccagggtcgcccgggcaaccctggtcgccaggcgcccgttgtcgagatatcgttgcatgggcaacagcagggccaggggaggcgccttctccaacagcacgtgcagcatctggtcggccgtgccgcgctcaaacgcccccaggacggcctggacgttgcgcgcgagctgctggatggcgcgcagctggcgatgcaggctaatgcccgtcccgtccagggcctcccccgtgagcagggcaatggcctcggtggccaggctgaaggcggcgttcagggcccggcggtcgatgaccttcgtcatgtaattatgcacgggctgctcgacggggtgcgggccgtcgcgggcgatgaggggctggtggacctcgaactgcacacgcccttcgttcatgtaagccagctccgggaacttggtgcacacgcacgccacggacaggccgagctccagaaagcgcacgagcgacagggtgttgcagtaggaccccagcagggcgtcaaactctacgtcatacaggctgttttcgtcggagcgcacgcgggcgaaaaaatcaaagagtctgcggtgggacgccacctcgatcgtactcaggatggagccggtgggcaccatggccgcggcgtaccggtaacccggggggtcgcgggcaggagcggccattgggttccttgggggattcgcaggctccatcaagccgagctcgggaaggccaagcccctcccgcacaacgcctcaccgccggcggacgcgactaacaacccacgggccgccaaaaccccaaggggcaacccgaccaacaacaggcgaggggaggaaaggcgtaaagggggcgttgggaggcaaaaagaaagaaaacacccagacgtaggcccgaggaccggccggcgtcctctgtccccgagcacccactgtgcccaacaggcacgggggcgagctgcccctgccttatatacccccccgccacacccccgttagaacgcgacgggtgccttcaagatggccctggtccaaaagcgtgctagaaaaaagttggtaaaggcggcaaagcagtccgccgccgccacccacatggcggcgccggccgcgcaggcgattcccagagaacgggcgcggaggggatccgtgcggggcagcagctggctggcggtgatccaatggaaaagcccgtcgggactgaacgtctcatgggcggccgccaccagggcgcacagggccgcgccgcccatgatcacgcacaacccccaaaacacgggtggcgacaacggcaggcgatcccgtttgatgttcacgtacaggaggagcgcccgtgccagccacgtgacatagtaggcgaggacggcggctataatacatgccggcgccaccgcccgtccggtccacccgtaatacatgcccgcggccaccagctccagcggcttgaggaccaggaacgaccaagcaaacatcaccacccgcttggaaaagaccggctgggtgtggggcggaagacgcgagtaggccgaactgacaaaaaaatcagacgtgccgtacgaggacagcgaaaactgttcatcgagcggcagttctccgtcctccccgccacacgcggcctcgtctaccagctcgcgatccaacaaaggaacatcatcccgcattgtcatggtcggtgcggggagccggcgaggcagcaaaaccgaaagtagtgctggcggcgcgggcccgggtccggacccaagcttcagggatggggggcggaggccaaaatcaaacaagcaccgcgcgggttctacacacaacccccacccgggtagtatccgcggatgcgagtgcctggcgaagtcacgtcccagcaggatataaacctcggccgttgggcccggaacccccgaaattcacacccacgccctgacgcccaaatcatgggtggatgtggttcgcgagccgcacatccgtgcgtccgccctcccccgcgggctgatgacgtggcggttagtcagtgggaaggcagggggaaagatgggttgggggaggaaacgaagaaaacacccagagggccacgtcgggaatgcgcccggagttgtccttaaaaggccggccgtgcgtgacggaagccgtcgtttgcccaagcaccgacgccgcgatccacagtggggggagttcctccgtccggccacaaccctacgcgcgggcggcacgcgcgagagcaacccacgggtcccgttcgcgccaccgccagcccttgctcccaccaccctcctcccaccaccccactattcccccccccaagtccgccccgtggctcgccggccatggagctcagctatgccaccaccctgcaccaccgggacgttgtgttttacgtcacggcagacagaaaccgcgcctactttgtgtgcggggggtccgtttattccgtagggcggcctcgggattctcagccgggggaaattgccaagtttggcctggtggtccgggggacaggccccaaagaccgcatggtcgccaactacgtacgaagcgagctccgccagcgcggcctgcgggacgtgcggcccgtgggggaggacgaggtgttcctggacagcgtgtgtctgctaaacccgaacgtgagctccgagcgagacgtgattaataccaacgacgttgaagtgctggacgaatgcctggccgaatactgcacctcgctgcgaaccagcccgggggtgctggtgaccggggtgcgcgtgcgcgcgcgagacagggtcatcgagctatttgagcacccggcgatcgtcaacatttcctcgcgcttcgcgtacaccccctccccctacgtattcgccctggcccaggcgcacctcccccggctcccgagctcgctggagcccctggtgagcggcctgtttgacggcattcccgccccgcgccagcccctggacgcccgcgaccggcgcacggatgtcgtgatcacgggcacccgcgcccccagaccgatggccgggaccggggccgggggcgcgggggccaagcgggccaccgtcagcgagttcgtgcaagtgaagcacatcgaccgtgttgtgtccccgagcgtctcttccgcccccccgccgagcgcccccgacgcgagtctgccgcccccggggctccaggaggccgccccgccgggccccccgctcagggagctgtggtgggtgttctacgccggcgaccgggcgctggaggagccccacgccgagtcgggattgacgcgcgaggaggtccgcgccgtgcatgggttccgggagcaggcgtggaagctgtttgggtcggtgggggctccgcgggcgtttctcggggccgcgctggccctgagcccgacccaaaagctcgccgtctactactatctcatccaccgggagcggcgcatgtcccccttccccgcgctcgtgcggctcgtcggtcggtacatccagcgccacggcctgtacgttcccgcgcccgacgaaccgacgttggccgatgccatgaacgggctgttccgcgacgcgctggcggccgggaccgtggccgagcagctcctcatgttcgacctcctcccgcccaaggacgtgccggtggggagcgacgcgcgggccgacagcgccgccctgctgcgctttgtggactcgcaacgcctgaccccgggggggtccgtctcgcccgagcacgtcatgtacctcggcgcgttcctgggcgtgttgtacgccggccacggacgcctggccgcggccacgcataccgcgcgcctgacgggcgtgacgtccctggtcctgaccgtgggggacgtcgaccggatgtccgcgtttgaccgcgggccggcgggggcggctggccgcacgcgaaccgccgggtacctggacgcgctgcttaccgtttgcctggctcgcgcccagcacggccagtctgtgtgagatatcccaataaagtgcagtcgttttctaacccacggatgccgttgtatgcctatacgggggactatggggggggaaaggaaaggaaacaggaatggagaagggaaaggaacagaggcggtagcggacgcacggcggacacaataacaaacagaccgcggacacggagggagtcggttgggttgggcgtggacgccgctgcgtccacacacccgtttattcgcgtctccacaaaaatgggacgcacgttcggaccaccctaaggatgcccgccagggccgcggtaatcataacgacccccagcgcggacgcggccagaaacccgggggcgatggtggcgatgggcagcgtgtcaaaggccagcagatgaatcacagttccgttggggaacaacaacagggccacggacggcacgtcgctggaaaacacgttcggggtgcccgccaccggcccctgggccagctgctgttgggtggcatccgtgtccaccagcagcaccgacatgacctccccggccggggtgtagcgcagaaacacggcccccacgaggccgaggtcgcgccggttttcggtgcgcaccagccgcttcggctcaatctcccgcgcgtgcccttcgcaggtggcggtgagataggtgataaacagcgggcggcggacgtcaacgcccgtaagcttgtatccgatcccgcggggcaagggggtgtgggtgacgacgtagctggcgttgtgggtgatgggcacgaggatccggggctccgcgttgtgcgacgggccgctacactggtgggtggcctccgggacgaaggcgcggatcagggcgttgtagtgcgcccagcgcgtgagaacggaggccacgccgcgggtctgttgtgccatgacgtccgccgggatgtcggatcgggtggccatggccagcgcgtccaggatgaacccgccctcggcgagatcgaagcgcagggaagctgcgcatggggaaaagtggtccgggagccagaagaggtttttctggtggtcggtcctggctagcgcggcccggagatcggcgtgggtcgccgcggcgacgtcggacgtacacagggccgtggttatgaggaggccccggcgggcgcgttcccgctgctcggccgagggcgcgcccgccaggaacggcgcccggaggacggccgtggcgtaaaacagcgctcggcggaccatcggggcggttagcgcgcggccgccgagaaactcggcgtacagggcgtcgatcaggcgggccgcgctcggggccaccgcgccataggccgcggggctgtccaacacgaacgccagctgatagcccagcgcgtgcgccgccaggctctgctctcgctcgaggatcgcggccaccagatgcccgaggcgcgcctccagccgcaggcgggccgccgggtccaacacggacacgttcaggaacaccgagtcggccgcgcagcccgctgctccccgggcggccaggccggccagcacgcgcgagtgggccaaaaagcccagcaggtcggagaggcgaatcgcgtcgtgggcgtgggccgcgttgacgaacgcaaaccccgacgaggcgagcagccccgcgaggcgccagaacagggacggacgcgcgtccgtgccggagcccgggtcctcccccaaaaactccgcataggcccgcgacatatactgggcgtagttcgtgctctcctcggggtagccggccacccgccggagggcgtccagcgccgagccgttgtcggcgggcgtcggggcccccaggacaaagacgcgatacctggggccggccggaggcccggggagcaccgcgggggcgttttcgtcggtcggatttccgacccgagcgagggtcttgtccgcaggcaccactatgatctcggccggagggctgtcccgcatcgatatcacgagccccatgaagcccttcccgtatcgcgcgcgcacgagcgcggcgtcgcacccgaacgccagcccgcccgtcgtccagacgcccacgggccacgtcgaggccgacggggagaggtacacgtaccgacccggagtccgtagcaggcccctggcggccagccaggtcacggatgcgttgtgcagatgcgcgatgctcaggttcgtcgtcggatgcctcggtgtccccgcgggcggccccgggggcggcgcgttgcgtcggccgtccgggtgcctctcggtcgccccgtcgtctccccgcgggaacgtaagcccctcgcggtccggcgcggccgcgaatgttacccaggcccgggaccgcaacagcgcggaggcgccggggttgtgcgacagtcccttgagctgggtcacctcggcggggggacgggacgtgggccccgcctcggggagctcgggcaggctcgcgttccgaggccggccgagcagataggtctttgggatgtaaagcagctgcccggggtcccgaggaaactcggccgtggtgaccaacacgaaacaaaagcgctcggcgtaccaccgaagcatgggcacggatgccgtagtcaggttgagttcgcccgggggcgccaagcgtccgcgctgggggtcgctggcgtcgggggtgttgggcaaccacagacgcccggtgtttgtgtcgcgccagtacgtgcgggccaaccccagaccgtgcaaaaaccacgggtcgatttgctccgtccagtacgtgtcatggcccccggcaacgcccaccaggacccccatcaccacccacagaccggggcccatggtcgtccgtcccggctgccagtccgcagatgggggggggtgtccgtacccacggcccaaagaggctccgcacctcggaggctatcggaggccctttgttgccgtaagcgcgggccaaaggatggggtggggtgagggtaaaagcacaaagggagtaccagaccgaaaacaaggacggatcggcccgctccgtttttcggtggggtgctgatacggtgccagccctggccccgaacccccgcgcttatggacacaccacacgacaacaatgccttttattctgttcttttattgccgtcatcgccgggaggccttccgttcgggcttccgtgtttgaactaaactccccccacctcgcgggcaaacgtgcgcgccaggtcgcgtatctcggcgatggacccggcggttgtgacgcgggttgggatcatcccggcggtgaggcgcaacagggcgtctcgacacccgacgggcgactgatcgtaatccaggacaaatagatgcatcggaaggaggcggtcggccaagacgtccaagacccaggcaaaaatgtggtacaagtccccgttgggggccagcagctcgggaacgcggaacagggcaaacagcgtgtcctcgatgcggggcagagaccccgcgccgtcctcggggtcggggcgcggggtcgccgcggcgacccccgtcagccggccccagtcctcccgccacctcccgccgcgctgcaggtaccgcaccgtgttggcgagtagatcgtagacacggcgaatggcggacagcatggccaggtcaagccgctcgcccgggcgttggcgtctggccaggcggtcggcgtgttcggcctccggaaggacacccaggaccaggttcgtgccgggcgcggtcgggggcatgagggccacgaacgccaacacggcctggggggtcatgcttcccatgaggtaccgcgcggccgggtagcacagcagggaggcgatagggtgccggtcgaaaacaagggtgagggccgggggcggggcttgcgggcccacagcctcccccccgatatgaggagccaaaacggcgtccgtcgccgcataaggcgtgctcattgttatctgggcgctggtcattaccaccgccgcctccccggccgatatctcgccgcggtccagacggtgctgcgtgttgtagatgttcgtcagggtctcggaggcccccagcacctgccagtaagtcatcggctcggggacgtagacgatattgtcgcgcggccccagggcctccatcagctgcgcggaggtggtggtcttccccaccccgtggggtccgtctatataaacccgcagcagcgtgggcagctccggatccccgcgggctccggaggccccctggcgatggctaggacgggacgccgcgcggccgtcggtaggcccgctcgcacgagcagcctgaccgaacgcaggcgcgtgctgttggccggcgtgagaagccatacccgcttctacaaggcgttcgcccgagaggtgcgggagttcaacgccaccaggatttgtggaacgctgctgacgctgatgagcgggtcgctgcagggtcgctcgctgttcgaggccacgcgcgtcaccttaatatgcgaagtggacctcgggccgcgccgcccagactgcatctgcgtgttcgaattcgccaatgacaaaacgttgggaggtgtgtgcgtcatcctggagctaaagacatgcaaatcgatttcttccggggacacggccagcaaacgcgaacagcggaccacgggcatgaagcagctgcgccactccctgaagctgctgcagtcgctcgcgcctccgggggacaaggtcgtctacctgtgtcctattttggtgtttgtcgcgcagcgtacgctgcgcgtcagccgcgtgacccggctcgtcccgcaaaagatctccggcaacatcaccgcggccgtgcggatgctccaaagcctgtccacgtatgccgtgccgccggaaccgcagacccggcggtcgcggcgccgggtcgccgcgaccgccagaccgcaaaggcccccctccccgacacgtgacccggaaggcacggcgggtcatccggccccaccagagagcgaccccccctccccaggggtcgtaggcgtcgctgcggagggtgggggtgtgcttcagaaaatcgcggcgcttttttgcgtgccggtggccgccaagagcagaccccggaccaaaaccgagtgaggttctgtgtgttgtttttttttttttttcctcgttttgttttctcttctttcccccccccctcccccgcttctggccaagcatcctcacctgcttaagcggaacccgcgggcgcgcggggactcatttgtcgccggcgacacccacccgacaacagcccctgggtgtcgaccgctgtcgcccccgtctgtcgcctctcccttttttccccccctcaaagaacgtggtgttgggcgccggccaattcttcccggagcgccgtcgtcgcccgcccgccgccctcgaacatggacccgtactaccctttcgacgcgctggacgtttgggaacacaggcgcttcatcgtcgccgactccaggagcttcatcacccccgagttcccccgggacttctggatgttgcccgtgttcaacatcccccgggagacggcggcggagcgggcggcagtgctgcaggcccagcgcaccgcggccgcggcggccctggagaacgccgccctccaggccgccgagctgcccgtcgacatcgagcgccggatacgcccgatcgagcagcaggtgcatcacatcgccgacgccctggaggcgctggagaccgcggcggccgcggccgaagaggcggatgccgcgcgggacgccgaggcgaggggggagggcgctgcggacggggcagcgccgtcgcccaccgcgggccccgccgccgcggagatggaggttcagatcgtacgcaacgacccgccgctacgatacgataccaacctccccgtggatctgctacacatggtgtacgcgggccgcggggccgcgggttcgtcgggagtcgtctttggtacctggtaccgcacgatccaggaacgcaccatcgcggacttccccctgaccacccgcagcgccgactttcgagacgggcgcatgtccaagaccttcatgaccgcgctggtcctgtctctgcagtcgtgcggccggctgtacgtgggccagcgccactattccgccttcgagtgcgccgtgctgtgtctgtatctgctgtaccgaaccacccacgagtcctcccccgatcgcgatcgcgctcccgttgcgttcggggacctgctggcccgcctgccgcgctacctggcgcgtctggccgcggtaatcggcgacgagagcggacgcccgcagtaccgctaccgcgacgacaagctgcccaaagcgcagttcgcggcggccggcggccgctacgagcacggggccctggccacccacgtcgtgatcgccacgttggtgcgccacggggtgctaccggcggccccgggcgacgttccccgagacaccagcacccgcgtgaaccccgacgacgtggcccaccgcgacgacgtcaaccgcgccgccgccgcgtttttggcacgcggccacaacctcttcctgtgggaggaccagacgctgctgcgggcgaccgccaacaccattacggccctggccgtgcttcggcggctcctcgcgaacggcaacgtgtacgcggaccgcctcgacaaccgcctgcagctgggcatgctgatcccgggagccgtcccggcggaggccatcgctcggggggcgtccggattggactcgggcgccataaaaagcggcgacaacaacctggaggcgctgtgcgttaactatgtacttccgctgtatcaggcagaccccacggtcgagctgacccagttgtttccggggctggccgccctgtgcctggacgcccaggcggggcggccactggcgtcgacgaggcgcgtggtggatatgtcgtcgggcgcccgccaggcggcgctcgtgcgcctcaccgcgctggagctcatcaaccgcacccgcacaaacaccacccctgtgggggagattattaacgcccacgatgccttggggatacaatacgaacagggcctggggctgctcgcccagcaggcacgcatcggcttggcgtcaaacaccaagcgattcgccacgttcaacgtgggcagcgactacgacctgttgtactttttgtgtctcgggttcattccccagtacctgtccgtggcctagggaagggtgggggtggtggtggtggggtgtttttctgttgttgtttctggtccgcctggtcacaaaaggcacggcgccccgaaacgcgggctttagtcccggcccggacgtcggcggacacgcaacaacggcgggccccgtgggtgggtaagttggttcgggggcatcgctgtattcccttgcccgcttccacccccccccccttcccgttttgtttgtttgtgcgggtgcccatggcgtcggcggaaatgcgcgagcggttggaggcgcctctgcccgaccgggcggtgcccatctacgtggccgggtttttggccctgtacgacagcggggacccgggcgagctggccctggacccagacacggtgcgtgcggccctgcctccggagaaccccctgccgatcaacgtagaccaccgcgctcggtgcgaggtgggccgggtgctcgccgtggtcaacgaccctcgggggccgttttttgtggggctgatcgcgtgcgtgcagctggagcgcgtcctcgagacggccgccagcgccgctatttttgagcgccgcggacccgcgctctcccgggaggagcgtctgctgtacctgatcaccaactacctgccatcggtctcgctgtccacaaaacgccggggggacgaggttccgcccgaccgcaccctgtttgcgcacgtggccctgtgcgccatcgggcggcgccttggaaccatcgtcacctacgacaccagcctagacgcggccatcgctccgtttcgccacctggacccggcgacgcgcgagggggtgcgacgcgaggccgccgaggccgagctcgcgctggccgggcgcacctgggcccccggcgtggaggcgctcacacacacgctgctctccaccgccgtcaacaacatgatgctgcgtgaccgctggagccttgtggccgagcggcggcggcaggccgggatcgccggacacacgtaccttcaggcgagcgaaaaatttaaaatatggggggcggagtctgcccctgcgccggagcgcgggtataaaaccggcgccccgggtgccatggacacatcccccgccgcgagcgttcccgcgccgcaggtcgccgtccgtgcgcgtcaagtcgcgtcgtcgtcttcttcttcttcttttccggcaccggccgatatgaaccccgtttcggcatcgggcgccccggcccctccgccgcccggcgacgggagttatttgtggatccccgcctctcattacaatcagctcgtcaccgggcaatccgcgccccgccacccgccgctgaccgcgtgcggcctgccggccgcggggacggtggcctacggacaccccggcgccggcccgtccccgcactacccgcctcctcccgcccacccgtacccgggtatgctgttcgcgggccccagtcccctggaggcccagatcgccgcgctggtgggggccatcgccgccgaccgccaggcgggtgggcttccggcggccgccggagaccacgggatccgggggtcggcgaagcgccgccgacacgaggtggagcagccggagtacgactgcggccgtgacgagccggaccgggacttcccgtattacccgggcgaggcccgccccgagccgcgcccggtcgactcccggcgcgccgcgcgccaggcttccgggccccacgaaaccatcacggcgctggtgggggcggtgacgtccctgcagcaggaactggcgcacatgcgcgcgcgtacccacgccccctacgggccgtatccgccggtggggccctaccaccacccccacgcagacacggagacccccgcccaaccaccccgctaccccgccaaggccgtctatctgccgccgccgcacatcgcccccccggggcctcctctatccggggcggtccccccaccctcgtatcccccagttgcggttacccccggtcccgctcccccgctacatcagccctcccccgcacacgcccacccccctccgccgccgccgggacccacgcctccccccgccgcgagcttaccccaacccgaggcgcccggcgcggaggccggcgccttagttaacgccagcagcgcggcccacgtgaacgtggacacggcccgggccgccgatctgtttgtgtcacagatgatggggtcccgctaactcgcctccaggatccggacttggggggggtgtgtgttttcatatattttaaataaacaaacaaccggacaaaagtatacccacttcgtgtgcttgtgtttttgtttgagaggggggggtggagtgggggggaaagtgggccgaatgacacaaaaattaggtcggaggggtgaggggggggggctaggagccgaaccgatggcccccacacgcgacggaaggcccggaagactaccacggggagggggtgtggaaagcgaccggtcgcagggagacggggttggtttggggttggtttggggttggttttcccgttagcacatgtctgcatttgtttttctagtcacacgccccccccccccaaataaaaaccaaggcaaaacaataccagaagtcatgtgtatttttgaacatcggtgtctttttatttatacacaagcccagctcccctcccctcccttagagctcgtcttcgtctccggcctcgtcctcgttgtggagcggagagtacctggctttgttgcgcttgcgcagaaccatgttggtgaccttggagctgagcagggcgctcgtgcccttctttctggccttgtgttccgtgcgctccatggccgacaccaaagccatatatcggatcatttctcgggcctcggccaacttggcctcgtcaaacccgcccccctccgcgccttcctccccctccccgcccacgcccccggggtcggaagtcttgagttccttggtggtgagcggatacagggccttcatgggattgcgttgcagttgcaggacgtagcggaaggcgaagaaggccgcgaccaggccggccaggaccagcagccccacggcaagcgccccgaaggggttggacataaaggaggacacgcccgagacggccgacaccacgccccccactactcccatgactaccttgccgaccgcgcgccccaagtcccccatcccctcgaagaacgcgcacagccccgcgaacatggcggcgttggcgtcggcgcggatgaccgtgtcgatgtcggcaaagcgcaggtcgtgcagctggttgcggcgctggacctccgtgtagtccagcaggccgctgtccttgatctcgtggcgcgtgtagacctccaggggcacaaactcgtggtcctccagcatggtgatgttcaggtcgatgaaggtgctgacggtggtgacgtcggcgcgactcagctggtgagagtacgcgtactcctcgaagtacacgtagcccccgccgaagatgaagtagcgccggtggcccacggtgcacggctcgagcgcgtcgcgggtgaggcgcagctcgttgttctcgcccagctgcccctcgatcagcgggccctggtcttcgtaccgaaagctgaccagggggcggctgtagcacgtccccggccgcgagctgacgcgcatcgagttctgcacgatcacgttgtccggggcgacgggcacgcacgtggagacggccatgacgtctccgagcatgcgcgcgctcacccgccggccgacggtggcggaggcgatggcgttggggttgagcttgcgggcctcgttccagagagtcagctcgtggttctgcagctcgcaccacgcgacggcgatgcgccccagcatgtcgttcacgtggcgctgtatgtggttatacgtaaactgcagccgggcgaactcgatcgaggaggtggtcttgatgcgctccacggacgcgttggcgctgggcgcctcccgcagtggcgcgggcgtggcattccggggcttgcggtcctgctcccgcatgtactcccgcacgtacagctcggcgagcgtgttgctgaggaggggctggtacgcgatgaggaagccccccgtggccaggtagtactgcggctggcccaccttgatgtgcgtggcgttgtacttgcgcgcaaacatgcggtcgatggcctcgcgggcatcccggccgatgcagtcgcccaggtcgacgcgcgagagcgagtactcggtcaggttggtggtgaaggtggtcgagatggcgtcggaggagaagcggaaggagccgccgtactcggcgcggagcatctcgtccacctcctgccacttggtcatggtgcagaccgccggtcgcttcggcacccagtcccaggccacggtaaacttgggggtcgtcagcaagttgcgggtcgtcggcgacgtggcccgggccttcgtggtgaggtcgcgcgcgtagaagccgtcgacctgcttgaagcggtcggcggcgtagctggtgtgctcggtgtgcgacccctcccggtagccgtaaaacggggacatgtacacaaagtcgcccgtcgccagcacaaactcatcgtacgggtacaccgaccgcgcgtccacctcctcgacgatgcagttgaccgtcgtgccgtaccgatggaacgcctccacccgcgaggggttgtacttgaggtcggtggtgtgccacccccggctcgtgcgcgtggcgaccttcgccggcttgagctccatgtcggtctcgtggtcgtcccggtgaaacgcggtggtctccatgttgttccgcacgtacttggccgtggagcggcagacccccttggcgttaatcttgtcgatcacctcctcgaagggaacgggggcgcggtcctcgaatatccccataaactgggagtagcggtggccgaaccacacctgcgacacggtcacgtctttgtagtacatggtggccttgaatttgtacggggcgatgttctccttgaagaccaccgcgatgccctccgtgtagttctgcccctccgggcgcgtcgggcagcggcgcggctgctcaaactgcaccaccgtggcgcccgtcgggggcgggcacacgtaaaactgggcatcggcgttctcgaccttgatttcccgcaggtgcgcgcgcagcgtggcgtggccggcggcgacggtcgcgttggcgtcggggggcggggtcgcctcgggccgcttgggcggctttttggttttccgcttccgggccttggtggtcgcggggctcgggacggggggcggccgggaggcgggacccccgttcgccgcgacggtcgcggccacgccgcccgaggcgcggggggccgccggggccgccggggccgccgacgccaccgcggccaccagcgcccccacgaccagcgcgcaaatcaagccccccccgcgcatggcgggcctacgggggcgcgtcgctcccgccgcccgctagtctgggggcgaggtgctgcaggaccgagtagaggatggaaaaaacgtctcggtcgtaaaccacgaccgagcggggtccgatgcagccgtcggggccgctctcgacgatggccaccagcggacagtcggagttgtacgtgaggtacacgcccggcgggtagcggtacagaccttcggaggtcgggcggctgcagtcggggcggcgcaactcaagctccccgcaccggtagaccgacgcaaagagtgtggtggcgataatgagctcgcgaatatatcgccaggcggcgcgctgggtgggcgtgattccggaaacaccgtcaaaacagtagaacttttgaaactcgctgacggcccaatcagcgcccgaaccccccgcgcccatgatgaagcgggcgagttcctccttgaggtgcggcaggagccccacgttctcgacgctgtagtacagcgcggtgttggggggctgggcgaagctgtgggtggagtggtcgaacaggggcccgttgacgagctcgaagaagcgatgggtgatgctggggagcagggccgggtccacctggtggcgcagcagcgacgctcgcatgaaccggtgcgcgtcaaacacgcccggggcggcgcggttgtcgatgaccgtgcccgcgcccgccgtcagggcgcagaagcgcgcgcgcgccgcgaagccgttggcgaccgcggcgaaggtcgcgggcagcacctcgccgtggacgctgacccgcagcatcttctcgagctccccgcgctgctcgcgcacgcagcgcccgaggctggccagcgaccgcttggtcaggcggtccgcgtacagccgccggcgctcccgcacgtccgcggcggcccgcgtcgcgatgtcgccccagctctccggcccctgcgcccctggctcggggccgcgctccccgtcctcgctcgcgggcgtccccgcgccacgcctccgccccccctcctccgcggcggcccggggctcttcctcctcggcccccccggtcgcgccgccggcccccagccgcgccagcacgcggcgcagcgcctcctcgtcgcactgctcggggctgacgagccgccgcagcagcggcgtcgtcaggtggtggtcgtagcacgcgcgtatcagcgcctcgatctgatcgtcgggcgacgtcgcctggccgccgatgatcagggcgtccaccatgtccagcgccgccaggtggcccccgaacgcgcgatcgaagtgctccgcccgccgcccgaacagcgccagctccacggccaccgcggcggtctcctgctgcagctcgcgctgcgccagcgcgttcaggttgtcggcgaaggcgtccatggtggagtggcgggcgcgatcgccggacgccagccagaagcgcagctcgctgatggcgtacaggccgggcgtagtggcctgaaacacgtcatgcgcctccagcagggcgtcggcctcctcgcggacagaagagctatcggcgggcggcgggccggcccgggccccgccgcccgccgcggtccgcgccagcgcctggtccagcacacagagcgctcgcgcgcgggcggcgtccgacagcccggcggcgtggggcaggtaccgtcgcagctcgttggcgtccagccgcacctgggcctgttgggtgacgtggttacagatgcggtccgccaggcggcgggcgatggtcgccccctggttcgcggtgacgcacagctcctcgaaacagaccgcgcacgggtgggacgggtcgctcagctccgggggcacgatgaggcccgaccccaccgccgccaccataaactcccggacgcgctccagcgcggccgtggcgccgctcgggggggtgatgaggtggcagtagttcagctgcttgagaaaattctcgacatcatgcaggaagcacagctccatgcggacgtccccgccgtacgtctgcagccggatctgctggtggtacggacagggtcgggccagacccatggtctcggtgaaaaaggcagagacgtcacccgtggtcgcgaacgtttccaggtggcccaggagccgctccccctcgcgccacgcgtactccaggagcaactccagggtgaccgacagcggggtgagaaaggcggcggcctgagcctccagccccggccgcaggtgccgccgcagcacgcgcacctggagcgcgttgagctttagctgggcgagcttccccaggccgatctgggggtcgcatcgtcgaagcagctctagctgaaaaacgtacgtctgtacctgcccgagcagggccaacagtttctgtcgggccgcagtgggctcggaaaccgcggccgggggcgcggccgccatggcgagtcacccggccgtgctgtggtttagttaaggtttgggggggggtgggtcagaggcgcgccccgcgcggactgatgcggcggcgggcccctgacatcccctctttatgcccgtcgcccgcccgcccgccccgccggtgtgccgtgattcgcggagtcggggccttgtgtttctttctttcccccccgaatccgttctttcttcctcacccccccctccccacacacccacccaggactcgccaccacaaggaggcgagagcccgtcgctaacccaaagacacagtcacgagacacgatatcgactgtagttgcgatcgtttattttatacacaacaccaacctttccttcgaccccccccacccccgcccctagagcatatccaacgtcaggtcctttttctccggtggtccctccccaaacggatcgtcgccgtgaaacgcccgctttcgggcgacgccggccgcccccgccgccgccgccaaaccgccgaacgacgccgcgtggtcatcctcgtcgccgaaatccccaaagttaaacacctccccggcggcgccgagctggctgaccagggcctccgcctcgtgggccacctccagggccgcgtcggtcgaccactcgccgtgcccgcgctccagggcgcgggtggtaaactccatcatttcctcgctcaggtactcgtcctccagcagcgccagccagtcctcgatctgcagctgctgggtgcgggggcccaggctcttgacggtcgccacaaacacgctgctggcgaccgccgccccgccctccgcaatgatgccccggagctgctcgcacagcgaatgctcgtgggccccgcccccgagactcgacgccgcgcacacaaacccggccctggggcaggccaggacaaacttgcgggtgcggtcaaagatcagcagcgggcacgcgtttttgccgcccagcaggctggcccagttcccggcctgaaacacgcggtcgttgccggccatgccgtagtatttgctgatgctgaggcccagcacgaccatcgggcgcgcggccatcacgggccgcagcaggttgcagctcgcgaacatggacgtccaggcgccggggtgcgcgtcgagggagtccatcagcgcgcgggccccggcctccaggcccgcgccgccctgcggggcccaggcggccgccgcctgcacgctggggggacggcgggacccggcgatgacggccgtgagggtgtttatgaagtacgtcgagtggtcgcagtacctcaagatctggttggccatgtagtacatggccagttcgctcacgttattgggggccaggttgataaagttaatcgcgccgtagtccagggagaacctcttaatgaacgcgatggtctctatgtcctcgcgcgacaagagccgggcggggagctggttgcgctggagggcggtccagaaccactgcgggttcggctggttcgaccccgggggcttgccgttgggaaagatgaccgcgtggaactgcttcagcaggaagcccagcggtccgaggaggatgtccacgcgcttgtcgggcttctggtaggcgctctggaggctggcgacccgcgccttggcggcctcggacgcgttggcgctcgcgcccgcgaacaacacgcggctcttgacgcgcagttccttgggaaacccaagggtcacgcgggcaacgtcgccctcgaagctgctctcggcgggggccgtctggccggccgttaggctgggggcgcagatagccgccccctccgagagcgcgaccgtcagcgtcttcgccgacaggaacccgttgttgaacaggtccatgacgcgccgccgcagcaccggttggaattgattgcgaaagttgcgcccctcgaccgactgcccggcgaacaccccgtggcactggctcagggccaggtcctggtacacggcgaggttggaccgccgcgcgaggagctgcagcagggggcacggcccgcaggtgtacgggtccagcgacagcgacatggcgtggttggcctcggccagaccgtcgcggaacttaaagttgcgcccctcgatcaggttgcgcatcagctgttccacctcgcgatccaccagctgcttgatgttgttcaccaccgtgtgcagggcctcgcggttgccgataatcgtctccagcctccccagggccgtgggcaccgcctggtccacgtactgcagggcctcgagctcggccatgacgcgctcggtggccgcgcggtacgtctcctgcatgatggtccgggtgttctcggacccgtccgcgcgcttcagggccgagaaggcggcgtagttccccagcacgtcgcagtcgctgtacgcgctgttcatcgttccgaagaccccaatggccccccgggcggcgctcgcgaacttggggtggcgggcccgcagccgcatcagcgtcgtgtgcgcgcaggcgtggcgggtctcgaaggtacacaggttgcagggcacgtcggtctggcccgagtccgcgacgtagcgaaacacgtccatctcctggcgcccgacgatgactccgccgtcgcagcgctccaggtaaaacagcatcttggccagcagggccggagagaacccgcacagcatggccaggtgctcgccggcgaactcctgggttccgccgacgaggggcgccgtggggcgcccctcgtacccgggcaccacgtggccctcgcggtccagctgcgggttggccgccacgtgcgtgccgggcacgagaaagaagcggtaaaaggagggcttgctgtggtccttggggtccgccggcccggcgtcgtccacctcggtcaggtggagggccgaattggtgctgaacaccatggcgcccacgaggcccgcggcgcgcgccaggtacgccccgacggcgccggcgcgggccgcgggcgtttcctggccctcaagcaggggccacgtggtgatgtcggggggcggctcgtcaaagaccgccatcgacacgatggactccagggccagggcggcgtcgcccgccatcaccgaggccaggcgctgctcaaacccgcccgccgggcccttgttcccggcgtcgcgcgcgccccgctggggcttaccctggctggcctcgaaggccgtgaacgtaatgtcggcggggagggccgcgccctcgtggttttcgtcgaacgccaggtgggcggccgcgcgggccacggcgtccacgttccgggcacgcagggccacggcggcgggcccgacgaccgcctcgaacagcaggcgggcgagggggcggttgaaaaacggaagggggtagttgaaattctccccgatcgatcggtggttgcagttaaacggatcggcgatgacccggctaaaatccggcataaacatctgcagcggatacacggggatgcggtgaacctccgcgtccccgatggttaccttgtccatcccgcccagatgcaggaaggtgttgctgatgcacacggcctcccggaagccctccgtgatcaccagatacagcaaggcccggtccgggtccagtccgagccgctcgcacagcgcgtcccccgtcgtctcgtgctttaggtcgcagggccggggcgcgtagtccgcgaagccaaaatggcggcgcgcccgctcgcagagccgcgtcaggttgggggcctgggtgctgggggccaggtggcggccgccgtgaaagacgtaaacggacgggctgtagtgcgagggcataagcttgagggacaccgcggtccccccaaggcccgtcgtgcgggacccgacgaccgcggccacgttggcctcaaacccgctctccacggtcaggccgacgatgaggggcgcgacggcgacgtccgcgtcgccgctgcgcgccgacagtagcgacagcagctccaggccttcggccggacaggcgcggccatacacgtaccccatcggccccggaggaaccttgacggtggtcgtcgttttgggcttggtgtccatggctttcgggagatcggcgaccggcaggaacgggggcccggcaagacgaccgggggcagacgggggaggccgcgcgtggtcgacggctgctgcccgccgtcgtctctccgatggggtcgaatgccggcgctgggggtggggtctacacccgcccgttcgccgagcggcccctggtgggggtgggatgggtgggatggggtgggcgagaatggcccgccaccggatcgcgccggacgggggggcccggggttgggcaaggtttgggcgcaaggctccagcggcgattcgagaggcctgcggatggcggcccagagctgggtatgctcggccggggcggccggtatatgtacggcgtgctgggaggggcggcgtcgggccccgcccacggtccgccacgccccgcgcgtcatcggcagggggcgtggccgcccttctaaaaaaagtgagaacgcgaagcgttcgcactttgtcctaataatatatatactattaggacaaagtgcgaacgcttcgcgttctcactttttttagaagggcggccacgccccctttgacgtcacgctcacccgggcggccggccgcccataagcgcggcctgccgggccgataaaaagaaaccgcggcgcccccgcggacaccacacactggctctcgaaccccggacgcgcagaagggacccgggcgcgggtccgccggtaagagccggggggaacatcggcaccgccatcccaccccgagctgttgggtgggcgggtgggggggctggtgaggcggtggtgggagggggcggcgtatagcaggacaacgaccggcggcgatgttttgtgccgcgggcggcccggcttcccccggggggaagccggcggctcgggcggcgtctgggttttttgccccccacaacccccggggagccacccagacggcaccgccgccttgccgccggcagaacttctacaacccccacctcgctcagaccggaacgcagccaaaggccctcgggccggctcagcgccatacgtactacagcgagtgcgacgaatttcgatttatcgccccgcgttcgctggacgaggacgcccccgcggagcagcgcaccggggtccacgacggccgcctccggcgcgcccctaaggtgtactgcgggggggacgagcgcgacgtcctccgcgtgggcccggagggcttctggccgcgtcgcttgcgcctgtggggcggtgcggaccatgcccccgaggggttcgaccccaccgtcaccgtcttccacgtgtacgacatcctggagcacgtggaacacgcgtacagcatgcgcgccgcccagctccacgagcgatttatggacgccatcacgcccgccgggaccgtcatcacgcttctgggtctgacccccgaaggccatcgcgtcgccgttcacgtctacggcacgcggcagtacttttacatgaacaaggcggaggtggatcggcacctgcagtgccgtgccccgcgcgatctctgcgagcgcctggcggcggccctgcgcgagtcgccgggggcgtcgttccgcggcatctccgcggaccacttcgaggcggaggtggtggagcgcgccgacgtgtactattacgaaacgcgcccgaccctgtactaccgcgtcttcgtgcgaagcgggcgcgcgctggcctacctgtgcgacaacttttgccccgcgatcaggaagtacgaggggggcgtcgacgccaccacccggtttatcctggacaacccggggtttgtcaccttcggctggtaccgcctcaagcccggccgcgggaacgcgccggcccaaccgcgccccccgacggcgttcggaacctcgagcgacgtcgagtttaactgcacggcggacaacctggccgtcgagggggccatgtgtgacctgccggcctacaagctcatgtgcttcgatatcgaatgcaaggccgggggggaggacgagctggcctttccggtcgcggaacgcccggaagacctcgtcatccagatctcctgtctgctctacgacctgtccaccaccgccctcgagcacatcctcctgttttcgctcggatcctgcgacctccccgagtcccacctcagcgatctcgcctccaggggcctgccggcccccgtcgtcctggagtttgacagcgaattcgagatgctgctggccttcatgaccttcgtcaagcagtacggccccgagttcgtgaccgggtacaacatcatcaacttcgactggcccttcgtcctgaccaagctgacggagatctacaaggtcccgctcgacgggtacgggcgcatgaacggccggggtgtgttccgcgtgtgggacatcggccagagccactttcagaagcgcagcaagatcaaggtgaacgggatggtgaacatcgacatgtacggcatcatcaccgacaaggtcaaactctccagctacaagctgaacgccgtcgccgaggccgtcttgaaggacaagaagaaggatctgagctaccgcgacatccccgcctactacgcctccgggcccgcgcagcgcggggtgatcggcgagtattgtgtgcaggactcgctgctggtcgggcagctgttcttcaagtttctgccgcacctggagctttccgccgtcgcgcgcctggcgggcatcaacatcacccgcaccatctacgacggccagcagatccgcgtcttcacgtgcctcctgcgccttgcgggccagaagggcttcatcctgccggacacccaggggcggtttcggggcctcgacaaggaggcgcccaagcgcccggccgtgcctcggggggaaggggagcggccgggggacgggaacggggacgaggataaggacgacgacgaggacggggacgaggacggggacgagcgcgaggaggtcgcgcgcgagaccgggggccggcacgttgggtaccagggggcccgggtcctcgaccccacctccgggtttcacgtcgaccccgtggtggtgtttgactttgccagcctgtaccccagcatcatccaggcccacaacctgtgcttcagtacgctctccctgcggcccgaggccgtcgcgcacctggaggcggaccgggactacctggagatcgaggtggggggccgacggctgttcttcgtgaaggcccacgtacgcgagagcctgctgagcatcctgctgcgcgactggctggccatgcgaaagcagatccgctcgcggatcccccagagcacccccgaggaggccgtcctcctcgacaagcaacaggccgccatcaaggtggtgtgcaactcggtgtacgggttcaccggggtgcagcacggtcttctgccctgcctgcacgtggccgccaccgtgacgaccatcggccgcgagatgctcctcgcgacgcgcgcgtacgtgcacgcgcgctgggcggagttcgatcagctgctggccgactttccggaggcggccggcatgcgcgcccccggtccgtactccatgcgcatcatctacggggacacggactccattttcgttttgtgccgcggcctcacggccgcgggcctggtggccatgggcgacaagatggcgagccacatctcgcgcgcgctgttcctccccccgatcaagctcgagtgcgaaaaaacgttcaccaagctgctgctcatcgccaagaaaaagtacatcggcgtcatctgcgggggcaagatgctcatcaagggcgtggatctggtgcgcaaaaacaactgcgcgtttatcaaccgcacctccagggccctggtcgacctgctgttttacgacgataccgtatccggagcggccgccgcgttagccgagcgccccgcagaggagtggctggcgcgacccctgcccgagggactgcaggcgttcggggccgtcctcgtagacgcccatcggcgcatcaccgacccggagagggacatccaggactttgtcctcaccgccgaactgagcagacacccgcgcgcgtacaccaacaagcgcctggcccacctgacggtgtattacaagctcatggcccgccgcgcgcaggtcccgtccatcaaggaccggatcccgtacgtgatcgtggcccagacccgcgaggtagaggagacggtcgcgcggctggccgccctccgcgagctagacgccgccgccccaggggacgagcccgcccccccagcggccctgccctccccggccaagcgcccccgggagacgccgtcgcatgccgaccccccgggaggcgcgtccaagccccgcaagctgctggtgtccgagctggcggaggatcccgggtacgccatcgcccggggcgttccgctcaacacggactattacttctcgcacctgctgggggcggcctgcgtgacgttcaaggccctgtttggaaataacgccaagatcaccgagagtctgttaaagaggtttattcccgagacgtggcaccccccggacgacgtggccgcgcggctcagggccgcggggttcgggccggcgggggccggcgctacggcggaggaaactcgtcgaatgttgcatagagcctttgatactctagcatgagccccccgtcgaagctgatgtcccgcatcttgcaataaatgtctgcggccgacacggtcggaatttccgcgtccgctggtttctctgcgttgcgtctgaccacgagcacaaacgtgctctgccacacgtgggcggcgaaccggtagccggggcacgcggtcagcatccgatcgatgagccggtagtgcaggtgggccgacgtgccggggaagatgacgtacagcatgtggcccccgtacgtggggtccgggtaaaaaagaaaccgggggtcgcacgccccccctccgcgcaggatcgtgtgcacgaaaaagagctcgggctggccgagcgtatcggccaggaggtcctggaggggggtgctgtggcggtcggccagcacgaccagggaggccagaaaggtgcggtgctcaaagatcgtattgatctgctgcacgaaggccaggatgagggcctcgcggctgacggtggccagccgcccgtcgcccgcgctgcacgcggggcagcagcccccgatccccaggtagtagcccatgcccgagagggtcaggcagttgtcggccacggtctggtccaggctgaaggggagcgacacgggggtcgtcttcaccaggggcacggagagcgagcgcacgatggcgatctcctcggagggcgtctgggcgagggcggcgaagaagccgcggtagcgacggcgctcgtgcaggcagagctccagcctgcgcgcgtgcgacggcaggctcttgcgggaggcccggcgctccacgccggggttcccggcggcggaaaagcgcgaccgccgccgggtcttgtcgcggccgggcccgggccgggagccggagcgacggggggcgatgtcatacataggtacagagggtgtgctccagggacaggagagagatcgagtgtcgtctgagcagcgcgccggcctcgcggacaaatgtggccagcgcggtgggcttcggcacaaatacctggtacgtcttgaaggtgtagatgagggcccgcagggctatacagacccgcccctcgaactcgttgccgcaggccaacttggccttgtgaagctgcagctcgtcgcgatggtcggcgcgggggtggccaaacaggacccaggggtcgacttccatctccgtgatggcgcacatcggatcgcagaacatgtgcttgaagatggcctcggggcccgcggcccgaagcaggctcacgaaccggcccccgtccccgggctgcgcctcggggtccgcctcgagctggtccacgaccggcactatgcagtcgaagaggctggtgttgttctccgagtagcggacgacggacgccctcaggcgtcgcatggccagccagtaggcccgcaccagcaacagattgcacagcaggcattccccgccggtgcgcccgcggccccggccgtgcttcagcacggtggccatcagcgggcccaggtccaggtcgggctgggcctggggctcggcgaactgcgcaaaacgcggggccgcgtcgcgcatgcgcgccccgcggtgcgcttcccaggactcgctgaccgcggcgcggcgggcgtccgcggcggcgcgcagccggggccccgactcccagacggcgggggtgccggcgagcagcagcaggatcaggtcggcgtacgcccacgtctccggctcacccccctgcgccagcgccccggcggcggcctcgaactccccgttgcgggcggcggcgcgcgtgcagcagctgtctccgcccccgcgcttgccctcggtgcagtcgagcaggcgggcgcagtccttccagttcatcagggcggtggtgagggagggttgcgttcccgagcccccgcccgcccccgcccccgccccgtcatcgcccccggaggccagggtcccgatgagggcccgggttgcggactgcgcgaggaaggaatagttggagtactgcaccttggcggcgcccggggagggcgtcggcctgggttgcttctgggcgtggcgcccgggcaccccgccgtcggtccggaagcagcagtggagaaagaaatgccggtggatgtcgttgatggtcagggcgaagcgcgcgaaggagccgacaagggtcgccttcttggtgcgcaggaagtggtggtccatgacgtagacgaactcgaaggcggccacgaagatgctcgcggcgcagtggggcgcgcccaggcacttggcgcagaggaacgcgtaatcggccacccactggggcgagaggcggtaggcctgcttgtacagctcgatggtgcggcagaccagacaggggcggtccagcgcgaaggtgtcgacggacgccgcggcgaagggccccgtgtccaagagtccctctgccgtggggtctgcgggcgggccgcgggcggaccccggcccccgcccccccgaagcctcgcgcgcggccccgcgcggccgcgggggggcgggcgcgacgtcgctctccacgtcctcgtcgagcgcgctcgcgggcggcacgcctaccacgtgacaggccgccaggagctcggcgcacagggcctcgttaagagccagaaggtcgggatcgaaggccacatacggacgctcgaacgcgccctccttccagctgctgcccggcgactcttcgcgcacggcggcgctcgacggcacccccggggcggacgtcgccatggccggtcgagcggggcgcacgcgtccgcgaacgttacgggacgcgatccccgactgcgcgctgcggtcccagaccctggaaagtctagacgcgcgctacgtctcgcgagacggcgcgggggacgcggccgtctggttcgaggacatgacccccgccgaactagaggttatattcccgaccacggacgccaagctgaactacctctcgcggacgcagcggctggcctccctcctgacgtacgccgggcctataaaagcgcccgacggccccgccgccccacatacgcaggacaccgcgtgcgtgcacggcgagctgctcgcccgaaagcgcgaacggttcgcggcggtcattaaccggttcctggacctgcaccagatcctgcggggctgacgcgcgcttcggcggggcaccggcaccgggaccgacttgttttacataacagtagggggtgggggaacgcgcacccttgcccggtcgcgatggcggggatggggaagccctacggcggccgcccgggggacgcgttcgagggtctcgttcagcgcatcaggctcattgttcccgccacgctgcgcggcgggggtggggagtcgggcccctactcgccatccaacccgccctcgagatgtgccttccagttccacggccaggatgggtccgacgaggccttcccgatcgagtacgtcctgcggctcatgaacgactgggccgatgtgccctgcaacccctacctgcgcgtgcagaacaccggcgtttcggtgctgtttcaggggttttttaaccggccccacggcgccccggggggcgcgatcacggcggagcagaccaacgtgattctgcactccaccgagacgacgggactgtccctcggagacctggacgacgtcaaggggcgcctcggcctggacgcccggccgatgatggccagcatgtggatcagctgctttgtgcgcatgccccgggtgcagctcgcgtttcggttcatgggccccgaggacgccgttcgcacgcggcggatcctgtgtcgcgccgccgagcaggccctcgcccgtcgccgccggtccaggcggtcccaggatgactacggggcggtggtggtggcggcggcgcaccactcttccggagcgcccgggccgggggtcgccgcctcgggcccgccagcgccgcccggacggggaccggcccgtccgtggcatcaggccgtgcagttgttccgggccccgcgtccgggccccccggcgcttctgttgctggcggcggggctgtttctgggggccgctatctggtgggcggttggcgcgcgcctatgaaagggggcgagccaccgtcccgcccgccagtgcatcccagacgcccgcgagccgcacatcccctccgctcccgcctccggcccgattcttacggcgcgacccaaggtcccgatggccgccccgcagtttcaccgccccagcaccattaccgccgacaacgtccgggcgctcggcatgcgcgggctcgtgttggccaccaacaacgctcagttcatcatggataacagctacccgcatccgcacggaacgcagggtgcggtgcgagagtttcttcgcgggcaggccgcggcgctgacggacctcggggtgacccacgccaacaacacgttcgccccgcagcctatgttcgcgggcgacgccgcggccgaatggctgcggccctcgttcggtcttaagcgcacgtattccccctttgtcgttcgcgaccccaagacccccagcaccccgtgagtcctcggcgggtccctccgcggccgtctctcgttgcccccctttcccccttcccgggtggttcaataaaaaacaccaacatacgatattcgcgtttgatacgtttattggggggggtgtagggcccaacgatcggcgattaacaacaccaaacaatcgagcgcgtctaacccagtaacatgcgcacgtgatgtaggctggtcagcacggcgttgctgcgctgaaacagcgccctgcgggtccgctgcagctgttgttgtatgcggcggcatgcgcggatcaaaaccgccagggcgctacgaccggtgcttcgtacgtagcgtcgcgacaagacggcatttgcctgtacgggcaaggggccaaattgcgagtgtggtgactggaggtggtcggcggccaatgggccgggtggttcgtcggcggggggcaagtgcggttccggtgggagggggtcgagcgcctcggtatcatccgagtccgagaaacgcagggagtctgcgtcggagtgttcatcatcggaggagatgtgcagcgtctgaagcagcgatgcgggtgggggcgcggagtcgacgtgaagcgcgagagaggaagcccacgaagtcacagcggacactgggaggtgggtgtttgtatgtgtgggagactcgggcgtcgggaccgagtctcggctctggggtgtaagcgtccgagttacgggcggcaggggcggctggggcaggggcggctggggcaggggcggctggggcaggggcggctggggcaggggcggctggggcaggggcggctggggcaggggcggctggggcaggggcggctggggcaggggcggctggggcaggggcggctggggcaggggcggctggggcaccgagcgcgcgcggatgcgcgtccgcgcggcgggtttggtcgcgggtgactggggtggggggcggcgggcaaccgggcctccgggcacgacccaaccgcacaaaggctcgctcggggcaaccgggcctggggccaaaggcggggggctggtctggacggcggaggtcgggggggcaaggcccggagaaggcggcactgccgccgctgcggcggaaaccgcggccgcgtggtcggctgggtcccggggagaggggagggagttcaacgaggccgagagcgaggcgaccgcggggcgcgtgaggcgccggggtgggccggccgcggggccccgggggggtgtcggcgagggacccgctgttgtctggcggcggccgcggcggcggtcgcccccggggacgaccgctccttcggcgggcggaggcgggatgggcgcgagcgtgggggcgggaaaggccccgcgagccgaggcggggccgggcggaaggggcaaagcagaaacccaagccgggggcgcggactccggggtgggcggctggtcgggaggacgcgcggaagcggcgaccggggcgaccggggcggggagtgccggcggacgccacccctcggggggggcggaggcccggggcgcgcgcgatttggcacgcgtccggcgggacctgcgcacgcgcggcacggcggcggagaaagcggcggcagagccggaaaaggccgggggaggaagcgcggcatccgcggggggactcggtgtgggtggcgagggccgtgggtcgtcgcgaggggccacgggcacgcgccccgtgttttgttgaggcgggacactcggtcgtgtttcgcgagccgtagctgccggcccgatgggccgcggtgcgtactgggacgtggggacggactgatcggtggcgggggggggaagaagggccggggccggattgggcgtggggccgccggcgtcgtcggacgccagctcctccaggccgtggatccaggcccacatgcgaggggggacgggctcgccggtggtggcgtcggtgaggagagtgggggcgaggacccccgggtccgcctgccgtgcggggggggcagcggggtcctcgggacccgatccgccatccccccccgcaaggtcccgcgggtcgcgggcggcggtcggggcagagggacctgcctcgtcggcgagggggcgctggtaaaccgggtgtcccgggaacagctcccccgtcaggagggaggcgtcgaagggccgcccgaggatggcccgcgcgaagaaggggtccgcgtcggcggcgctcgccgcgagaacgtcccccgcggtagccacaaacggaagctcctcggtggcctcgctgcccacaaaccgcacgtcaggggggccggggggctccggggcttcccacaagaccgcgaccggggtcatggagatgtccacgaggaccaggcacgggggcccgtcggcgagagggcgctcggcgatgagcgccgacaggcgcgggagctgcgccgccagacacgcgttttcgatcgggttgagatcggtgtggaggaggccgacggcccacgtctcgatgtcggacgacacgacgtcgcgcagggcggcgtccggcccgccggggcgcgagtcgaagagcgtcaggcacagttccagttccgactcgcgggagaaggccgtggtgttgcggagcgccaccacgacgggcgcgccgaggagcaccgcggccagaaccaggtccatggccgtaacgcgcgcggcgggggtgcggtgggtcgcggcggccagcacggccacgtgctggcccgtgggtcggtagagggcgtggggggcctcggggagggacgccttgcgcccccccgccgggccgagcgtctggccagactccaggcgtgcggccaggagggcgtcgaagctgtcgtactcggtgtagtcgtcgggaaacatgcaggtccacagcgcggccaaagcggcgctcggcagacacatgcgcccgaggacgctcaccgccgccagggcctgggccggactgagcttcccgagcgccgggacgtcccggcgctgggtcccgagctccaaggccgagcgccagggcgccagcgggtcggtttcggacagcttgccccggcgccagtcggccagccgcgtgccgaacaggaggccccgggtcggggggcctccgtccaaaaacgtcggcaacacgcggatgcgggcgtcgggatgcggggtcaggcgctggacgaacagcatggactccgctgcgtcctcgaacgcgcgttcgagggtgaggtgcatgtactcgtgctggcgaacgaggtccaggcgccagaagttgtagatgtgttccggaacgccggccaccagcgcgaccagcacgtcgttctcgttgaaggcgacgcagtggcgctgggacccccgggggcccggcggcggacgcggcgccgccgctccggacgcccagcccagctgggcccagcgacacccaaactcgcgcgtgagggtggtggcgacgagggcgacgtacagctcggccgccgcgtccatcgaggcgccccacgtcgcctggcgatggcgcacgaagcgaccgaacagctgaaagttggcggcctgggcgtcgctgagggccagctggagccggttcacgacggtcagcacgtacatggccgtgaccgtcggggccgattcgaggacgtccgtcggaagcgggggccgcacgcaggccgcctcgggacgcatcagcagcgcgccgagtttgtcggtgacggccgggaagcatagcgcgtactgcagcggcgttccgtccggggccaaaaagctggtggcgaacggcagatccagagcgctgacggcctcacgcagcaccaggggccccgggtctccgccggcgcgcagatacgcctcgccccggcggcgcagcagctgcgggtcgacctcgtggccctcgggggaagaagaggcccgggcgcgggcgtcgagggcgcgaagatcaacgagcaggggcgcgggcgcggactccgcgcccgcgcccgtctggccgccggccctggcgtacgcgctatataagcccatgcggtattggatgagttcccgcgcgccccggaactcctccaccgcccacggggccaggtccgcggccgccgcgtcgaactccgccagcaggcgccccagggcgtcaaagttcatctcccagggcaccctgcgcaccacctcatcccgcagccgggcgcacagggcggtgtgcttggtgacgcgcgcgcccagctcctccacggcctccgcgcgctcggcgcccttggcgcccaggacgccctggtacctggcggaaaggcgctcgtaggccggctgggcccgcagccccgacaccgtgttggtggtgtcctgcagggcgcgcagctgctcgtgcatggcgcggaacccctcgggggacttccaggcgcccccccggacgcggccaaagcgaccccagacctcgtcccactccgcctcggcctcctccagggacctccgcagggcgtcgacgcggcgccgagtatcaaagagcgcccccaggcggccggcgtgccgcgccagggggccggggccgtcgccgcgggcggcgcttagcgggtgcgtctcgaaggtgcgctgggcgtgctctagccagataaccgcgggcacgtcgagctcgcgcgttttctcggtctgatccaacagaacctcgacctggtcggcgatctccgccaccgagcgcgcctggtcgagcgtcttggccacggtcgccgggacggcgaccaccttcagcatggtcttgaggttggccaggccctcggcctcgatctgggcccggcgctcgcgcgcggccagcgcctcccgcaggcccgccatgacccgctcggtggcctccgcgcgctgctgtttggcgcgcaccactgcgtccttggtctcggccgtgtcctgccgggtcacgaaggcgacatactcggcgtacgccgtgttcttcacggggctctggtccacgcgctccaacgccgccgcgcacgcgaccagcgcgtcctcgctgggacacggcagggtgaccccggtccggaccagctccgcggtggcctccgggtcattccgggccgcggatatctgctccgcggcggccgccaggtccaggggcacgccgccgagcgcccggtgcacgtcggcccggatggcgtccaggcgatcgcggagctccacgtagtcggcgtagccatgttggaagaacggcacgtaccggcgcaggccgggcacgctcgtcatgtcgtccgccaggcgccccacggcctcgtggtagtcgataaacccgtcgcccgcctgggccatttccaggagcccctccgcgatgcgcagcagccgcgccaggggctcggcgtcgacccgaaacatgtcggcgtaggtttcggcggcggcgtggaacgccgcgctccagccgaggcggtggatggcggcgagcggggggagcatggggtggcgctggttctcgggggtgtaggggttaaacgcgaaggccgtatccagggcgagggtgaccgcctcggcgttggccgcgagcgcctgctcggcgcgcttgcggaagtcccgggggttgtagccgtgcgtgcccgccagcgcctgcaggcggcgcagctcgaccacgtcgaactcggcgcggttctcgacgcggtccagcgccgcctcgacgccggcggcccagcgctcgctgctgccccgggcgcgctgggccgccatcttcgccgtcaggtcggcgacggcggcctcaagttcgtcggcgcggcgtcgcgtggcgccgatgaccttgcccagctcctgcagggcgcgcccgctgggggaatggtccccggccgtcccttcggcgtgcagcaggcccccgaacccagcctcgtgccccgcgaggctttcccgagcagcggtcgtcgcgcgggccgcggcatcgatgagggcggcatggtccccctccggctgggcgcaggcccggcgcgcctggactaccaggtcggcggccgccgaccccagggtcgtgagctcgtcgatggccccccgcgcctccagggccagccgagtcgcctttacataccccgcggcgctatcggccagcaccgcgaggaaggacaggggcgaggccgggtcgcgggcggccgcgcccagggccgacaccgcgtccgccagggcgccatgcgcccgcacggccgcgtccaccgtcgccgcgggacttgccgtcgcgacggcggcgctcccggcgttgatggcgtttgacacggctttggcgattgtgggggcgtgatcggaaaagaactgcacgaggaccggcgtctcgggggcgtcggcgaacagggtcttcagcaccaccacgaaggcgggatgcaggccggccagagccgtcgcggtatccggggtcgggtgttccagggcctcccggtactgccccagcagcccccacaggtccgcccgcagcgccgccgtgacttccgggggggggccccggacggcatcggccaggtcggtccaccccgcgggcagggaggcccgcagggtcgccagcacggccggacacgcctttagccccacaaagtccgggaggggccgcaggaccccttggagtttgtgcaggaacttctcccgggcgtcgtgggccaccttggcgcgctcccgcgcgtcgttgagcatcgcctccagggcgtgggcgcgctcccgaagccgggagcgcgcctccggagcgagctccgccgtcatcttggccgcctccatggccctcgcctgccgcagcgcgtcttcggccatgcgcgtggcctcgggggacagcccgcccccgtcgacgtacggcgcggggccggtcgccgggacgaaggccgcgtcgctgtccagctgctgcgcgagcgccgcgtcgagggcgtcgaagcgctgcagttcggccagccccgagctgcgccgcgcctgctggtcgttgatgccgtggatgctgcgcgccagctcttccaggggcttgcgttcgatgagcccctgggtcgcggcgtcggtcaggaccgagagccaggccgccaggtcctcgggggcatctagggtctggccccgctggagcaggtcccgcagcaggatggcctgggggctggtggcgagggggggcgggggggggagcgcggcgcgctgagcgacgtcccgcgtgtgttggtcaaaggccggtagcgattccagcaactggaccatgggcacgaccgcggccgaggccacgtgaaaccgacagtcgtggctgtcgctggcctgcagggccttcgcgctgtatacggctccccggtggaagtactccttgaccgcgctctcgatcgcccggcgggcctggatccgcacgtcctccagccgcgcctggatggcctcggggcccagggcgggcgggcacggggccctgccgccggcgcccggggcggcgggcacgggcatcacggtcaggggcccggcgcgctgcgagaccgagtcgaccccgcgggcgagggcgtctaaggcctcgcgcatctcgcgggcctccgcctcgacccgcatctcttcgccccgggcaaactgggccagcgcctggatccgatggagaagcggctccgggtgcgtcggggtggcgggggcgaacagggtgttcgggtgggcgcgcgagcgctccaggagccactctccgaggcgtgcgtacagattggccggcggggcggcgcgcagctgcagatccaggtccgcgaggtccccgtaaaaggcgtccgtctcccgaataacgtccctggcgaccaggaccagcttagcgagggccaggcgcccgatctgcgaattttcgtccagcacgtgctggatgaggggccggtgggcggccacgtccgccaggctcatgcgcgtggacgccaggaagtccccgacggccgttttgcggggcagcatgcgcagggtgaagtccagcagggccgcggccgggccggccaccccggcctgcgtatgcgtgcgggccccgttctcgatcaaaaaggcgaggacgcgctcaaagaagaagatgacgcagagctccaacagccccgggtgcgccgggtacggcgaccgcagggcgttgatggtgagctgcgaacacgcggccacctcgcgggccagggcggcatcgcgcgccgcgagccggaccgccgtggcggccacattggggtggacctcgaacagctgcgccaggtcggcgccggggggctccggggggcggcgggcccccagcgtctcgagcacggacggcgacgacgggctcgcgggcccgtcgtcgccgccgccctgcccggactgcgggggggtatccggtgcgggagggaccgtggcggctatgggcgtcggggaggaggcggggacctcggcggcgacgggggccttcttcttgggcgcggacttcttcttggccttggcgggcggggccttgggggcgggcctctcgcccgaggtcagatcctccacgctggacggtggggtccaggtgggccggcggcgcttgggcaagccggtagaatagcgcgcccggtggcgacccaccggcactgcccccacctccaggacccgcaggtcctcggcttcttcggccgcgtccccggcgggtgtctgcgggggcggggcggcgtgcggtggacccgaggccgcggcgtccggggccgagggcttcgcgggcggggtcccctccagggctgctgcccacacatcatcgggggggcggtttgggtgccccgcctgcggtgtgtcgggtgggcccgaggccccccggggggcctcggggggccggtcggccccaggggtctggacgtgggtgggcgcggggagcgcggggacgaccgggcccgagccttctccgtcccccctggggaccacaccgacaaagagcgccccgagccccccgatctcgccccgcagggggtgggtgatggccacgcgccgctcgacgaacggttcgtcctgcaggtaagtctcgctggccccgtagaggtgcagggccgcggcggtcaggtccgccggcgccacggcccccgggccggagggcacaaaaaacaccatggcgcccgcccaccgcaccttggggcggtcgtgggcgtaatacgtcaggtacgggtacacgtcgcccgcccgcaccttggcgataaacgcgggcgttcccgcgggcaggccgtgcgggtcaaacagataggccgtgtcgccgtcccggtagagccccatgcccagggggccgatggtcaggagcgtgtaggacagcggccgcatggcccaggggccggcgaagaacgtgtgcgcggggcattgcgtctccagcagccccgccgtgggctccccgaagaagcccacctcgccgtacacccgcgaaaacacgcaacgcaggccgccgcgcgccgccgggtactccaggaagttggggagctcgataatggaacacatgcgcggcggcccggagcccgcggccgcgcgcgtccactcgcccccctccaccagacatccctcgatggcctccgcggacagcacgtcgcggggccccacgtcgaaaagaagactgagaaacgacagggacgagcgcatgcacgataccgacccccccggctccagatcggtcgcgaactggttccgaacaccggtgaccacgatatcgcgatccccctggcgcttcatcgtggggtgaggtagcgcggccggaatcatgtgtgccgcgcccgccacgagcggggcctgtttatgggccgggcgtcccgatgagtactgttgtttccgccgcccgaacccccccgcccatcaaccgcctgttcgtccccctaaccacacacccggtatcgcgtgtgtgtggtttcccgggaagacacatcccaccccatgaagttttgccctttttttccgtcccgcactacgccacctttccaccccccccccaaaaaaacaacaaccaactcccagatggatgggtgcgataataaagctttattattgtttaaccaaaggcgagtcctacgggtgtaccggtggtgtctcctgcggcgtcatctcgtcgtcctccacgggggtgttgggccaagggaccgtctcgcggcccgccgggcgcgtcgacggcgcgcgggcctgcgtgtcctgtgggccgggtgtcgtgggttcgggggtgctaccgccggcatcttgggcctccaggtccccgggggcccccgggccggcggaaggccgaaacgccgaggcgcgaaacacgccgtcggtgacctgcaggagctcgtttattaatagccagtccatgctcagcgtagcggccagcccctggggagacaggtccacggagtccggaaccaccgtcggctgacccaggggccccaggctgtagtccccccaggcccccaggtcatgacggttcgtgagcacgacgaggtctgcggccgggctggggggcgcgtcctcggtcgcgtgggccatcacctcctgaatggctgcggtgcgctgatcggccgagctggcgaagggcgccacgaccagcgcgcgctccgtctgcaggcccttccacgtgtcgtggagttcctgaacgaactcggccacccgctcggggcccgtggccgcgcgtgcggcctgatagccggccgagaggcgccgccagcgcgccaggaactgactcatgtaacagaacccggggacctggtcccccgacatcaactttgacgccctggcgtggatgcccgacacgatggccaggaacccgtggatttcccgccgcacgacggccagcacgttaccctcgtgcgagacctgggccgccagctcgtcgcataccccgaggtgcgccgtcgtctcggtgacgacggaccgcagccccgcgagggacgcgaccagcgcgcgcttggcgtcgtgatacatgccgcagtactggctcaccgcgtcgcccatggcctcggggcgccagggccccaggcgctcgtgggcgtctgcgaccacggcgtacaggcggtgcccgtcgctctcgaaccggcactcaaagaaggcggcgagcgtgcgcatgtgcagccgcagcagcacgatcgcgtcctccagctggcggaccagggggtcggcgcgctcggcgagctcctgcagcaccccccgggccgccagggcgtacatgctgatcagcagcaggctgctgcccacctcgggaggctgggggggaggcagctggaccgcgggccgcagctgctcgacggcccccctggcgatcacgtacagctcgcgcagcagctgctcgatgttgtcggccatctgcatcgtgggcccgacgccggcccgggtggccggttcgaggagggtgatcagcgcgcccaattttgtgcggtgcccctcgacggtggggagatagcccaggccgaagtcgcgcgcccaggccagcacccgcagggcaaactcgatggggcggggcaggtaggcagcgttgcacgtggccctcagcgcgtccccgaccaccagggccagcacgtaagggacgaaccccgggtcggcgaggacgttggggtggatgccctccagggccgggaagcggatcttggtggccgcggccaggtgaaccgagggggcgtggctaggcggcccgacggggagcagcgcggacagcggcgtggccggggtggtgggggtcaggtcccagtgggtctggccgtacacgtcgagccagatgagcgccgtctcgcgcaggaggctgggctggccggcgctgaagcggcgctcggccgtctcaaactcccccacgagcgtgcgccgcaggctcgccaggtgttccgtcggcacggccgggcccatgatgcgcgccagcgtctggctgaggacgccgcccgacaggccgaccgcctcacagagccgcccgtgcgtgtgctcgctggcgccctggatccgccggaacgttttcacgtagccggcgtagtgcccgtactcccgcgcgagcccgaacacgttcgcccccgcaagggcaatgcacccaaagagctgctggatctcgctgagcccgtggccggggggcgtccgcgcgggcacccccgccaccaaaaacccctccagggccgatatgtactgggtgcagtgcgcgggcgtgaaccccgcgtcggtaagcgtgttgatcaccacggagggcgagttgctgttctggaccaaagcccacgtctgctgcagcagcgcgaggagccgttgctgggccccggcggagggcggctcccctagctgcagcaggccggtgacggccggacggaagatggccagcgccgacgcactcagaaacggcacgtcggggtcgaagacggccgcgtccgtccgcacgcgcgccatcagcgtccccgggggcgcgcacgccgaccgcgggctgacgcggcttagggcggtcgacacgcgcacctcctcgcgactgcgaaccattttggtggcctcgaggggcgggatcatgatagccgggtcgatctcccgcaccgtgtgctgaaactgggccagcagcggcggcgggaccaccgcgccccgatcgggggtcgtcaggtactcgtccaccagcgccagcgtaaacagggcccgcgtgaggggggtcagggcggcgtcgtcgatgcgctgtaggtgcgccgagaacagcgtcacccaattgctgaccagggccaagaaccggagaccctcttgcacgatcggggacgggaagagcaggctgtacgccggggtggtcaggttggcgccgggttgccccaggggaaccggggacatcttaagcgacatctccccgagggcctccagggaggtccgcgggttcatggccaggcagctctgggtgacggtccgccagcggtcgatccactccacggcacactggcggacgcgcaccggccccagggccgccgtggtgcgcagcccggcggcctccagcgcgtgggtcgtgtcggagccggtgatcgccaggaccgtgtccttgatgacgtccatctcccggaaggccgcctcgggggtctcggggagcgccaccgccatgcggtgcaccagcagcccggggaggttctcggccaagagcgccgtctccggaagcccgtgggcccggtgcaaggcgcacagttgctccaggagcgggtgccagcacgcccgcgcctccgccgggccgaccgccgcgcccgacaacagaaacgccgccgtggcggcgcgcagtttggccgcggacagaaacgccggctcgtccgcgctgcccgccggctcgctcgagggggagggcggccggcggaggttggtcaggctccccaacaggacctgcaacggtccgtttgggggtggagcggacgggggggtcatgccggcgggcgccgggacctggagcgcgctgtccgacatggcgaccggcgtgcgcgctcggcgacgcggcgcggagaccgcgggcccaaacgggaatgactgccgccgccctatacggaggggctaagtatcgcccggggacccttcgaaaccccgggcgtgtcgcaagtacgccgcgaaggcgcggcgtgttatacggcgcgttatgtcccggcattccgttcgtgggttcgggcccgggtgctgtcgggtgggagtgtgtgtgggggggggcggcgcgacggcggcccggaccaagtgtatcgcggccgttccgtggggcggcccaacaggccctttaaacatttgcgtatgcaccggcccagccagtcggacaccggaacccaccagaggcggaagccgccttcgcccgtgagggtgcgtgtgttttctggtggcgtgtttttcctttccgccctcctccctccccacctccaccacccccccccacaactcgcccgttggcgatcggcgggaaaaccatgaaaaccaagccactcccgacagccccgatggcgtgggccgagagtgccgtggaaaccaccaccagcccgcgcgagctcgcgggccacgccccgctccggcgcgtcctgcgcccgcccatcgctcgccgcgacggcccggtgcttttgggggacagggcccccaggaggacggccagtacgatgtggctgctggggatcgaccccgcggagtcgtctccgggaacgcgcgctacccgagacgataccgagcaggccgtggacaagatcctcaggggagcccggcgcgcgggagggctgaccgtccccggcgccccccgctatcacctgacccgccaggtaaccctgacggatctctgccaaccaaacgcggagcgggccggggcgctccttttggccctgcggcaccccaccgacctcccccacctggcccgccatcgggctccgcccggccggcagaccgagcgactggccgaggcctggggccagctcctggaggcctccgccctggggtccgggcgggccgagagcggctgcgcgcgcgcgggccttgtgtcgtttaactttctggtggccgcgtgcgccgccgcctacgatgcgcgcgacgccgccgaggcggtccgggcccacatcacgaccaactacggcgggacgcgggccggggcgcggctggaccggttttccgaatgcctgcgcgccatggtccacacgcacgtgtttccccacgaggtcatgcggtttttcggggggctagtgtcgtgggtcacacaggacgagctggctagcgtcaccgccgtctgcagcggaccccaggaggccacacacaccggccacccgggcaggccccgttcggccgttaccatcccggcctgcgccttcgtggacctggacgccgagctgtgcctggggggccctggggcggcgttcctgtacttggtcttcacctaccgacagtgccgggaccaagagctctgttgcgtgtacgtggtcaagagccagctccccccgcgcggactggaggcggccctcgagcggctgttcgggcgcctccggataaccaacacgattcacggggccgaggacatgacgccccctcccccgaaccgaaacgttgactttccgctcgccgtcctggccgcgagctcgcaatccccgcggtgctcggcgagccaagtcacgaacccccagtttgtcgacaggctgtaccgctggcagccggatctgcgggggcgccctaccgcacgcacctgcacatacgccgccttcgcagagctgggtgtcatgccagacgacagcccccgctgtctgcaccgcaccgagcggtttggggcggtcggcgttccggttgtcatcctggagggcgtggtgtggcgccccggcgggtggcgggcctgcgcgtgatcgtctattgacgacggccgcccaacccgagcgaccttcccctcccacttccccccccctacacaccaactccgccctcgccgtcttggccgtgcgcggccccgtgcgtccgtctcaataaagccaggttaaatccgtgacgtggtgtgtttggcgtgtgtctctgaaatggcggaaaccgacatgcaaatgggattcatggacacgttacacccccctgactcaggagataggcatatcctccttagattgactcagcacacgatcgcaccccacccctgtgtgccggggataaaagccaacgcgggcggtctgggttaccacaacaggtgggtgcttcggggacttgacggtcgccactctcctgcgagccctcacgtcttcgcccaccgattcctgttgcgttcctgtcggccggtgctgtcctgtcgacagattgttggcgactgcccgggtgattcgtcggccggtgcgtcctttcggtcgtaccgcccaccccgcctcccacgggcccgccgctgtttccgttcatcgcgtccgagccaccgtcaccttggttccaatggccaaccgccctgccgcatccgccctcgccggagcgcggtctccgtccgaacgacaggaaccccgggagcccgaggtcgccccccctggcggcgaccacgtgttttgcaggaaagtcagcggcgtgatggtgctttccagcgatccccccggccccgcggcctaccgcattagcgacagcagctttgttcaatgcggctccaactgcagtatgataatcgacggagacgtggcgcgcggtcatttgcgtgacctcgagggcgctacgtccaccggcgccttcgtcgcgatctcaaacgtcgcagccggcggggatggccgaaccgccgtcgtggcgctcggcggaacctcgggcccgtccgcgactacatccgtggggacccagacgtccggggagttcctccacgggaacccaaggacccccgaaccccaaggaccccaggctgtccccccgccccctcctcccccctttccatggggccacgagtgctgcgcccgtcgcgatgccaggggcggcgccgagaaggacgtcggggccgcggagtcatggtcagacggcccgtcgtccgactccgaaacggaggactcggactcctcggacgaggatacgggttcggagacgctgtctcgatcctcttcgatctgggccgcaggggcgactgacgacgatgacagcgactccgactcgcggtcggacgactccgtgcagcccgacgttgtcgttcgtcgcagatggagcgacggccccgcccccgtggcctttcccaagccccggcgccccggcgactcccccggaaaccccggcctgggcgccggcaccgggccgggctccgcgacggacccgcgcgcgtcggccgactccgattccgcggcccacgccgccgcaccccaggcggacgtggcgccggttctggacagccagcccactgtgggaacggaccccggctacccagtccccctagaactcacgcccgagaacgcggaggcggtggcgcggtttctgggggacgccgtcgaccgcgagcccgcgctcatgctggagtacttctgtcggtgcgcccgcgaggagagcaagcgcgtgcccccacgaaccttcggcagcgccccccgcctcacggaggacgactttgggctcctgaactacgcgctcgctgagatgcgacgcctgtgcctggaccttcccccggtcccccccaacgcatacacgccctatcatctgagggagtatgcgacgcggctggttaacgggttcaaacccctggtgcggcggtccgcccgcctgtatcgcatcctgggggttctggtccacctgcgcatccgtacccgggaggcctcctttgaggaatggatgcgctccaaggaggtggacctggacttcgggctgacggaaaggcttcgcgaacacgaggcccagctaatgatcctggcccaggccctgaacccctacgactgtctgatccacagcaccccgaacacgctcgtcgagcgggggctgcagtcggcgctgaagtacgaagagttttacctcaagcgcttcggcgggcactacatggagtccgtcttccagatgtacacccgcatcgccgggtttctggcgtgccgggcgacccgcggcatgcgccacatcgccctggggcgacaggggtcgtggtgggaaatgttcaagttctttttccaccgcctctacgaccaccagatcgtgccgtccacccccgccatgctgaacctcggaacccgcaactactacacgtccagctgctacctggtaaacccccaggccaccactaaccaggccaccctccgggccatcaccggcaacgtgagcgccatcctcgcccgcaacgggggcatcgggctgtgcatgcaggcgttcaacgacgccagccccggcaccgccagcatcatgccggccctgaaggtcctcgactccctggtggcggcgcacaacaaacagagcacgcgccccaccggggcgtgcgtgtacctggaaccctggcacagcgacgttcgggccgtgctcagaatgaagggcgtcctcgccggcgaggaggcccagcgctgcgacaacatcttcagcgccctctggatgccggacctgttcttcaagcgcctgatccgccacctcgacggcgagaaaaacgtcacctggtccctgttcgaccgggacaccagcatgtcgctcgccgactttcacggcgaggagttcgagaagctgtacgagcacctcgaggccatggggttcggcgaaacgatccccatccaggacctggcgtacgccatcgtgcgcagcgcggccaccaccggaagccccttcatcatgtttaaggacgcggtaaaccgccactacatctacgacacgcaaggggcggccatcgccggctccaacctctgcaccgagatcgtccacccggcctccaagcgatccagtggggtctgcaacctgggaagcgtgaatctggcccgatgcgtctccaggcagacgtttgactttgggcggctccgcgacgccgtgcaggcgtgcgtgctgatggtgaacatcatgatcgacagcacgctacaacccacgccccagtgcacccgcggcaacgacaacctgcggtccatgggcattggcatgcagggcctgcacacggcgtgcctgaagatgggcctggatctggagtcggccgagttccgggacctgaacacacacatcgccgaggtgatgctgctcgcggccatgaagaccagtaacgcgctgtgcgttcgcggggcgcgtcccttcagccactttaagcgcagcatgtaccgggccggccgctttcactgggagcgcttttcgaacgccagcccgcggtacgagggcgagtgggagatgctacgccagagcatgatgaaacacggcctgcgcaacagccagttcatcgcgctcatgcccaccgccgcctcggcccagatctcggacgtcagcgagggctttgcccccctgttcaccaacctgttcagcaaggtgaccagggacggcgagacgctgcgccccaacacgctcttgctgaaggaactcgagcgcacgttcggcgggaagcggctcctggacgcgatggacgggctcgaggccaagcagtggtctgtggcccaggccctgccttgcctggaccccgcccaccccctccggcggttcaagacggccttcgactacgaccaggaactgctgatcgacctgtgtgcagaccgcgccccctatgttgatcacagccaatccatgactctgtatgtcacagagaaggcggacgggacgctccccgcctccaccctggtccgccttctcgtccacgcatataagcgcggcctgaagacggggatgtactactgcaaggttcgcaaggcgaccaacagcggggtgttcgccggcgacgacaacatcgtctgcacaagctgcgcgctgtaagcaacagcgctccgatcggggtcaggcgtcgctctcggtcccgcatatcgccatggatcccgccgtctcccccgcgagcaccgaccccctagatacccacgcgtcgggggccggggcggccccgattccggtgtgccccacccccgagcggtacttctacacctcccagtgccccgacatcaaccaccttcgctccctcagcatcctgaaccgctggctggagaccgagctcgtgttcgtgggggacgaggaggacgtctccaagctctccgagggcgagctcggcttctaccgctttctgtttgccttcctgtcggccgcggacgacctggtgacggaaaacctgggcggcctctccggcctcttcgaacagaaggacattcttcactactacgtggagcaggaatgcatcgaggtcgtccactcgcgcgtctacaacatcatccagctggtgctctttcacaacaacgaccaggcgcgccgcgcctatgtggcccgcaccatcaaccacccggccattcgcgtcaaggtggactggctggaggcgcgggtgcgggaatgcgactcgatcccggagaagttcatcctcatgatcctcatcgagggcgtcttttttgccgcctcgttcgccgccatcgcgtacctgcgcaccaacaacctcctgcgggtcacctgccagtcgaacgacctcatcagccgcgacgaggccgtgcatacgacagcctcgtgctacatctacaacaactacctcgggggccacgccaagcccgaggcggcgcgcgtgtaccggctgtttcgggaggcggtggatatcgagatcgggttcatccgatcccaggccccgacggacagctctatcctgagtccgggggccctggcggccatcgagaactacgtgcgattcagcgcggatcgcctgctgggcctgatccatatgcagcccctgtattccgcccccgcccccgacgccagctttcccctcagcctcatgtccaccgacaaacacaccaacttcttcgagtgccgcagcacctcgtacgccggggccgtcgtcaacgatctgtgagggtctgggcgcccttgtagcgatgtctaaccgaaataaaggggtcgaaacggactgttgggtctccggtgtgattattacgcaggggaggggggtggcggctggggaaagggaaggaacgcccgaaaccagagaaaaggaccaaaagggaaacgcgtccaaccgataaatcaagcgccgaccagaaccccgagatgcataataacgattttattactcttattattaacaggtcgggcatcgggaggggatgggggcgcgcgtttcctccgttccggctactcgtcccagaatttagccaggacgtccttgtaaaacgcgggcgggggcgcgtgggcccacagctgcgccagaaaccggtcggcgatgtccggggcggtgatatgccgagtcacgatggagcgcgctaaatcttcgtcgcggaggtcctgatagatgggcagtctttttagaagagtccagggtccccgctccttggggctgataagcgatatgacgtacttgacgtatctgtgctccaccagctcggcgatggtcatcggatcgggcagccagtccagggcctccggggcgtcgtggatgacgtggcggcgacgtccggcgacatagccgcggtgttccgcgacccgctgcgcgttggggacctgcacgagctcgggcggggtgagtatctccgaggaggacgaccgggcgccgtcgcgcggcccaccggcgacgtccgggggctggaggggggggtcttcttcgtagtcgtcctcgcccgcgatctgttgggccagaatttcggtccacgagatgcgcgtctcgaggccgaccggggccgcggtcagcgtaggcatgctctccagggagcgcgagttggcgcgctcccgccgggccgcccggcgggcctgggatcggctcggggcggtccagtgacactcgcgcagcacgtcctcgacggacgcgtaggtgttattggggtgcaggtctgtgtggcagcggacgaacagcgccaggaactgcgggtaactcatcttgaagtactgcagcaggtcgcggcagtgaatcgtcggaatgtagccggtgctgatgtccaacacgatatcgcagcccatcagcaggagatcggtatccgtggtatgcacgtacgcgaccgtgttggtatgatagaggttcgcgcaggcgtcgtcggcctccagctgacccgagttgatgtaggcgtaccccagcgcccgcagaacgcggatacagaacaggtgagccaggcgcagggccggcttcgagggcgcgcccgagggggccgccgggcctgggccggcggcccgcgttccccggtcccccggggcgaaggcgtgcccgcggcggcgcatgttggaaaaggcgaaactgggcctggagtcggtgatgggggaaggcggcggcgaggcgtctacgtcactggcctcctcgtccgtgcggcactgggccgtcgtgcgggccaggatcgccttggccccgaacacaaccggctcggtacactcgaccccgcgatcggtcacgaagatggggaacagggacttttgggtaaacacccgtaacatactacagagacagtgtagcgtgattgcctcgcggtcgtaacttgggtagcggcgctgatatttaaccaccagggtatacatgacattccacaggtccacggcgatgggggtaaagtagccctccggggcccggaggccccggcgcttcaccagatggtgagtctgggcaaacttcatcatgccaaacagacccattccggcacgattgtaggtgcggataggtctctctacagagctgtataggtgtgacggtccgggacacccaagcccgccgcccctgtgtacagtggctgcggcgacgaccccgctccaacaagacgctatcccgggaaaggcacgctctttataattcttttttatttcccatctacgtgcggattggtgcaaccgccggcgcgcgccggtgcaggccgaccatctctctcttccccccctccccctcccccgagccctcaaagagggtgtggcctaactagcggaaggcgtatttaaccagactagggcggcgggtccgccgtagtccttggctcgggtagccactgctctgtggctcgggtcccccggcccccctaacccccatccggtccgcgtcatccgccccctccgcctgcgacacaaacggccgcgcctccgggcccggtgacacgacgcgcctcgtctctgcggattgtcccgggagcgtcgcggcatggctcatcttcccggcggtgcggccgccgcccccctttcggaggacgcgatcccgtcgccgcgcgagcggacggaagactggccgccctgccagatagtgctgcagggcgccgagctgaacgggatcctgcaggcctttgcgccgcttcgcacgagccttttggactcgctcctggtcgtgggcgaccgaggcatccttgtacataacgcgattttcggcgagcaggtgtttctgcccctcgaccattcgcagttcagtcgctatcgatggggcggacccaccgcggcgttcctgtctctcgtggaccagaagcgatccctgctgagcgtgtttcgcgccaaccagtaccctgacctgcggcgggtggagctgacggtcacgggccaggccccgtttcgcacgctggtgcagcgcatatggacgaccgcgtccgacggagaggccgtggagcttgccagcgagacgctcatgaaacgcgagttgacgagcttcgcggtactactcccccagggcgaccccgacgtccagctgcgcctcacgaagccccagctcacgaaggtggtgaacgccgtcggggacgagaccgccaaacccaccacgttcgagctcggccccaacggcaagttttccgtgtttaacgcgcgcacctgcgtcacctttgccgcccgcgaggagggcgcgtcgtccagcaccagcgcccaggtccagattctgaccagcgcgctgaagaaggcgggccaagcggccgccaacgccaagacggtctacggggaaaacacacaccgcacattctcggtggtcgtcgacgactgcagcatgcgggcggtcctccggcggctccaggtcggcggggggaccctcaagttcttcctcacggccgacgtccccagcgtgtgtgtcaccgccaccggccccaacgcggtgtcggcggtgtttcttttaaaaccccagcgggtctgcctgaactggctcggccggagcccgggttcctcgaccgggagcttggcgtcccaggactctcgggccggcccgaccgacagccaggactcctcctccgagccggacgcgggcgaccgcggcgccccagaagaagaaggcctcgagggccaggcccgggtaccgcccgcgttcccggaaccgccgggaaccaagcggaggcaccccggggccgaagttgtccccgcggacgacgccaccaagcgcccgaagacgggcgtgcccgccgcccccacgcgagccgagtcgccccccctctccgcgagatacggacccgaggcggcggagggtggtggggacggcggccgctacgcgtgctactttcgcgacctccagaccggcgacgcgagccccagccccctctccgccttccggggtccccaaagacccccatacggctttgggttgccctgacggcaacgggtggtggccgaacgcctcaccgcgcccgggcacgcggggtgcgttgtgttaaaaaaataaataaatggggtagtgtgtcccccccccctccaaccaatatggctgtcgtgtgtggttccgggttgcgcctccgtcctttccaccccccttccccctccttttttgttttgcgtgcgcttataagagcgggcccggggcccttcgcagcttcaccgagagcgccgtcgggccccgggtgcgggatgtgtcgcggggacagccccggggtcgcgggcgggagcggcgaacactgcctcggaggggatgatggggacgacgggcgcccccgcctcgcctgcgtgggtgccatcgctcgggggttcgcgcatctctggctccaggccgccacgctgggcttcgtggggtctgtcgttctgtcgcgcggcccgtatgcggacgccatgtcgggggcgttcgtgatcgggagcaccggcctggggttcctccgcgccccccccgcgttcgcccggccgccgacgcgtgtgtgcgcgtggctgaggctggtcggcgggggagcggccgtggccctgtggagcctcggggaggccggcgcgcctccgggggttccgggcccggcgacccagtgcctggcgctcggggccgcctacgcggcgctgctggtgctggccgacgacgtccatccccttttcctcctcgccccgcggcccctgtttgtcggcaccctgggggttgtcgtcggcgggctgacgataggcggcagtgcgcgctactggtggatcgacccccgcgccgccgcggccctgacggcggcggtggtggcgggcctcgggacaaccgccgccggggacagcttttccaaggcctgtccccgccaccgccgcttttgcgtcgtctccgcggtcgagtctcccccgccccgatacgccccggaggacgccgagcggccaacagaccacggacccctgttaccgtcgacgcaccaccagcgatctccgcgggtctgcggcgacggggccgcacggcccgaaaacatctgggttcccgtggtgacctttgcgggcgcgctcgcgctggccgcctgcgccgcgcgagggtctgacgcggctccgtcaggcccggtcctgccgctgtggccccaggtgtttgtcgggggccacgcggcggcgggcctgacggagctgtgtcagaccctcgcgccccgggacctcacggacccgctgctgtttgcgtacgtcggattccaggtcgtgaaccacgggctgatgtttgtggtccccgacatcgccgtatacgcgatgctggggggcgccgtgtggatctcgctgacgcaggtgcttgggctccggcgccgccttcacaaggacccagacgccgggccctgggcggccgcgaccctgcggggcctctttttctccgtctacgcattggggtttgcggcgggggtgctggtgcggccgcggatggcggcgagccggcggtcggggtgatcgccatttcaaataaaaggcacgagttccccgaataccaccggcgtgtgatgatttcgccctaccgctccgatccccggggggaggggggaaggaaatgggggcgggggtgccgtggacgggtataaaggccaggggggcaggcgggcccatcactgttagggtgttaggttgggaggtggcacaaaaagcgacactcccgtgttgtagttgtccgcgggaggcggtggtttccggcaaccctcctcgctgcgccgggcgcgcccaccggtccttcgcgggggccggggctcttctggtcatggcccttggacgggtgggcctagccgtgggcctgtggggcctgctgtgggtgggtgtggtcgtggtgctggccaatgcctcccccggacgcacgataacggtgggcccgcgggggaacgcgagcaatgccgccccctccgcgtccccgcggaacgcatccgccccccgaaccacacccacgcccccccaaccccgcaaggcgacgaaaagtaaggcctccaccgccaaaccggccccgccccccaagaccgggcccccgaagacatcctcggagcccgtgcgatgcaaccgccacgacccgctggcccggtacggctcgcgggtgcaaatccgatgccggtttcccaactccacccgcacggagttccgcctccagatctggcgttatgccacggcgacggacgccgagatcggaacggcgcctagcttagaggaggtgatggtaaacgtgtcggccccgcccgggggccaactggtgtatgacagcgcccccaaccgaacggacccgcacgtgatctgggcggagggcgccggcccgggcgccagcccgcggctgtactcggtcgtcgggccgctgggtcggcagcggctcatcatcgaagagctgaccctggagacccagggcatgtactactgggtgtggggccggacggaccgcccgtccgcgtacgggacctgggtgcgcgttcgcgtgttccgccctccgtcgctgaccatccacccccacgcggtgctggagggccagccgtttaaggcgacgtgcacggccgccacctactacccgggcaaccgcgcggagttcgtctggttcgaggacggtcgccgggtgttcgatccggcccagatacacacgcagacgcaggagaaccccgacggcttttccaccgtctccaccgtgacctccgcggccgtcggcggccagggccccccgcgcaccttcacctgccagctgacgtggcaccgcgactccgtgtcgttctctcggcgcaacgccagcggcacggcatcggtgctgccgcggccaaccatcaccatggagtttacgggcgaccatgcggtctgcacggccggctgtgtgcccgagggggtgacgtttgcctggttcctgggggacgactcctcgccggcggagaaggtggccgtcgcgtcccagacatcgtgcgggcgccccggcaccgccacgatccgctccaccctgccggtctcgtacgagcagaccgagtacatctgccggctggcgggatacccggacggaattccggtcctagagcaccacggcagccaccagcccccgccgcgggaccccaccgagcggcaggtgatccgggcggtggagggggcggggatcggagtggctgtccttgtcgcggtggttctggccgggaccgcggtagtgtacctcacccacgcctcctcggtgcgctatcgtcggctgcggtaactccggggccgggcccggccgccggttgtcttcttttccaccccttccgtcccccgtacccaccacaccccaccccacccccccgccgtcccccgggcgttataagccgccgcactcgcttttcccaccggaaaatcctcggcccgatccgaacggcgcacgccgcgtgggctccaaacgcctccggaagagagcgccccgccccgatattcaagcccgcggtggtgctatggctttccgtgcttcgggacccgcctaccagcccctcgcccccgcggcctccccggcgcgggctcgtgttccggccgtggcctggatcggcgtcggagcgatcgtcggggcctttgcgctcgtcgccgcgttggttctcgtaccccctcggtcctcgtggggactctcgccgtgcgacagcggctggcaggaattcaacgcgggatgcgtcgcgtgggaccccacccccgtcgagcacgagcaggcggtcggcggctgcagcgcgccggccacccttatcccccgtgcggccgccaagcacctggccgctctgacacgcgtccaggcggagagatcgtcgggttactggtgggtgaacggagacggcatccggacctgtctgagactcgtcgacagcgtcagtggcatcgacgagttttgcgaggagctcgcgatccgcatatgctactacccacgaagccccggcgggtttgtccgcttcgtaacttcgatacgtaacgccctggggttgccgtgaggcgcgcgtccgacggtcccgcttctcgcctctcttcttcccccaccccacccaccgaccaacgacggcgtttggccaataccctccttttttctttttctcttccccccccccccaaaaaaaacaataaacagctaattgcgtacgacaaaccatgcggaactcgctgttttttttctctgtttgttactttttattgaaacagacatacggggaaaggggccggaaaccgagacggtggggccggcggtcgcatttttttaatggctctggtgtcggccgcgtttgagcttcgtcaacagggcgctgagggcggcgacgttcgtcgggccgtcgttggccagcgcgttggtccgggggcgggcgggcatgggcgacaggcttagtcccgggtccggggcgcgtgtggcccccggaggggagaagagggcagacccgccccagtcgtacaggggattttccgcctcgatgtacggggagtccggggcgtctcccggcagggcggccccgccggcaagacgccggcgagggcagatgttttcgtatacccgaacccaggggatctcctcgtagacgcgccccccatcctcgcccaccgactcgtaaatggaatctgcgtcctcggagggggcgcggggggcgtggctttcggccggccaggcggcggcggcggtggtgtcggcggcgggggtggcgccaagcccgacgcccgcgggcatggcggcgtcatcgtcgggcagcagatacgtgttttccatctggtccggttcggcctccgcgtccggcccccaggtccgcaccgcgtcgtagaccccggcggcctcgcgctgagccgcgagcgggcgcgccgcggctgccggccgctgctcggggggcgcggggttgcggggcgggaggcgcgggggcgccccggccatatgcgtgtaatacgtggccggccggccggcgcagggctcgggaccccggtcggccgcgtcgacgtgcgggggctcggggaggtcctcgcggtggcgcctgaacctccgaggggccgcgggggtcgagtgggggcgagcccgggggagcggcgggggtgcgttgtcgcgccgggtccgttgtatcttgtcccggcagctcccgccgaccgcgccgcggccccccggtgggccggacgccgcgaggcgcaggatggactcgtagtggggcgacggggttccgctccgaagcaggtccggggccagggcggccccgaaccaggacttgatgctgagttccatccgggcccagctcggggcggtcatcgtggggaacaggggggcggcggtcctgcagaagcgctcctggctgtccaccgccgcccgtaggtactcgttgttcaggctgtcggaggcccagacgacatacccggtaagcgtcgcgttaattatatactgggcgtggtggtggactatggatagaacctcgacggtcgagacgatggcgtccacgatcccgtacgtgccgccgctgcgcttgccggtctcccacaggtgggccaggcgcgtcaggtggcccaggacgtcgctgaccgccgcccgcagggccatgcactgcatcgagcccgtggtgccgctgggcccgcggtccaggtggcgcgcaaacgtctccgcgggcgcctccagactcccgctgagcgccacgaaccggcgatcggcggggcccaggcggcgacacacgtacttgtccgccgtccacagcatccacgaggcccaatggtacaacacggagacgtaggccaggagctcgctcagccgcagtgcggtgtccgtgctcggccggctcgggtctgcggggcgcataaagaacatgtactgctggagcctgtgggccgcgtcgcgcaaccccgccaccgcggcggcgtacttggccgcggcggccccgctcttgaacggggcgcgcaccagcagcttcgggagcagggtgggccgcagcagcacgtgcaggctggggtcgcagtcgcccgccgggtcgtcggggatgtccaggccgctgggcacgaccgtctggaggtacttccagtactgcgctaggatggcgcggctcagctggccgcccgacagctccacctcgccgagcgcctgcttggcggccgacgcgtagtgccggatgtagtcgtagtgcgggtcgctggcgagcccgtctacgatcaggctctcggggacggtgttatggtgccgcgccgccagccggacgctgcgatcggcgccggtcagaaacgccggctgcaggtcgtcggcgcgctgccgcaggacgcccacggccgcgctgaggagcccctccggggtggggagcagacacccggcgaagatgcgccgctcggggacgcccgcgttggcgccgcggatgaggttggccggcgtcaggcaccgcgccagccgcagggagctcgcgccgcgcgcccggcgttgcatggcggagaccgttcggtcgggggccccgccggtcggaggtatgccgcgtcccgggatatagggttgctttttatggggaggcgcctatgggcgtggcgggccgcccagcccggtcgcgcgcctcccggacacgtgcgcccggagggcggcggtctcctcgtcgcccatgagcagtttccgaaactgcgccatgatgtccacgacgcggacccgcggccccagcacggactcgctattcaggggggcgggggggaaggccgccaggtcttcgagcaggaaggcggggtctgccgtcccgctcacgggcgcccggggcgccgaggacgcggggcgaaggtccacgtgttccgcggcggcgcgcacgtccgcccaaaatttggcgggggtggtccgcgcgtacaggggctgggtcgcgcggaggacgcacgcgtagcgcaggggggtgtacgtgcccacctcgggggccgtcgacccgccgtcaaacgcggccagggccacgcacgcgaccaccgtgtcggccaggcccagcagccgctgcaggatgagccccgtcgccagcacggcgcgcgcggccgccgcgtcgtccctgcgccggcgcgcgtccccgcaggccagggcgtatttcagggtaacggtcgccagggccgtgtgcagcgcgtacacggccgcgcccagcacggcgttcagcccgctggtggcgagcaggcggcgcgccgcggtgtcgcccagcgcctcgtgctcggccgccacgaccccggggctgcccaggggcagggcgcgaaacagcgcctcctgctccacgtccgcaaacgcggggtgggcggagtgcgggtgcaggcgcgcccccacgaccaccgagagccactggaccgtctgctccgccaggaccgccagcacgtccaggacgcgccccgcaaacgcggcctcccgcgggagcacgcatttgacggcgccggggttgaagcgggcgagcagagccccggtggcgatgtacgtcatgcgccccgcgtagcgggcggccacgcgacagtcgcgccccaggagcgcgcgcaccccgggccagtacagcagggaccccagcgaactgcgaaagaccgcggcgtcggggccggggtgggggggcgcggcccctcccgcgctgagcagcggcacggcggcggcccccacgggccgcaacgccgtgaggctcgcgaactgccgtcggagctcggccgccctgtcgtcgagctccgagccgcgcccctccgtgtgcaggcgcgtcccgcagacccacccgttgatcgccacccgcacgatggcgtccaccagaaagcccatcgcgcgggaggggctggtttttgcccgccgatccgtcaggtcgaggatcgcgtcgcccgtgacgtaccaggccagcgcctcgccctgctgcagcgtctggcggaaaaacacctttgggtcggccggggaggcaaagtgcatgacccccacgcgcgacagcccgaacgcgctatccggacacgggtagaacccggccggatgtcccagggccagggccgagcgcacggactcgtcccacgcggcgactcggggggtcaggcggtccagggggaatgccgcctgcagctccgggcccgacacgcggcccgcgagaatctcgaccgtcgcggaaggccgcgccccggcgccgtcatcgtgcgcgacggcggcggggtagtcgtcctcctcgtagttgagctcgtccaggaacagcggcgagggcaccacccgcgaaccgcccacccgccccaaaacgtcgcgtgggtccatcgggcccaggtagcctccccgcggggcccgcgtgatggcgctgtcccggcgtccgcgaacggactggctcctggccgtaacggacctggggcgcggaaaggacgcccggcgggggggcgccgccgcccgggcctcggacgcgcgtcgggacccggggtgaccgcgggcctcccggcgacggcgcgggggcggctcttcgctcgccatctcccccgcggcctcgacctcgctgtcgtcgtccacgttaaacaccgcccgcaggtaccccattaacccgactccaccgccctcgggctcgtcctccacgggcgagtcggcgcgatgcgcggacggggcatgggaccgggtggaggcgcgcctccggcgtacggcatgcccgcgcacggacatggtggccggaggcccgattttttacacacgccctccccgcagacggacgaggaaaggggtggtgcgaggggggaggcccaaacggggaggtggggggtagggggcggtcccagggagcggggggtaggaaccggcacgacgggaacagagaaaacgcgaccgctccaacaagggtgggggggtgggcctcgtccccacgcagacccgcgggcaaatgcgagaacgggacccgcgcgcctgcctttatacgcggaccccagcaccacgagccgttctgtgacgcgaatctacacgaccgcgggctcgtaggcgcgactaacgcccaacccaacggcacacaccccccaccccgcgcgtaaccccatttctttcatggtcccgtaataaacagccaacgcacgccgcgtatgatgagttgcttgccaatgtttattgctgtggttgcgaaccctctatcgcgatacagacggaggtgaggcggggcggtggtgggggggggcgcgccgcccggtcgcacatcctaccccccaaagtcgtcaatgcccatggcatcggtaaacatctgttcaaactcaaaatcgtccacgtccaaagccccatacgagacggggtcgtgggtcattcccggggagggggactccacgtcccccagcatctccaagtcgaagtcgtccagggcgtcggcgggcgtcatatccacctcctcgccgtccaggcggagttcgtctcccaggctgacgtcggtaatgggggcggtggtggacagtctgcgggggcgttgtcccgcggagagaaacgacatgcgcggcgccaccagcccggcctccgcgggagcgtcatcgtcgtccgggaggtcgagcaggccctcgattgtcgatccgtaattgtttctggtccgcccgcggctatacgcgtgctcccgcatgacggactcgccctccgaggtcgcgacgctggagtacgagtccaacttggcccggatcagcagcataaagtacccagaggagcgggcctggttgccctgcaggacgggcggggtcgtgaggggcgccccgggttcctccgccgccgcacttcgcaccagcgggaggttcaggtgctcgcgaatgtggtttagctcccgcagtcgccgggcctccacgggaactccccgcacggtgagcgatccgttgataaacatcaggggctgaaacagacacgccaactggcgccagctctccaggtcgcagcagaggccgtcgaacagatcgggccgcatcatctgctcggcgtacgcggcccataggatctcgcggctcagaaagaggtatagatgcagaaacaggacgcgcgccaggcgcgcggtctcgcggtagtacctgtccgcgatcgtggtgcgcagcatctcccgcaggtcgcggttgcggccccgcatgtgtgcctggcggtgtagctgccgaacgctggcgcgcaggtaccggtacagggccgagcaaaaatttgccaacacggtccggtagctctcctcccgcgcccgcagctcaccgcggaaaaactgcgccatggcctcgtagtacgaaggcagctcgtcgcgggtggcgggcagggtggggaacgccacgtcgccgtgggcgcgaatgtcgatcggggagcgctcggggacgtgcgcatccccccagtcgatcacgtcgctgggcagcgtcgacagaaacttgcactcccggtacatgtcggcgttggtcgggaacccagagaacaggtcctcgttccaggtatctagcatggtacacagcgcgggacccgcgctgaagcccagatcgtcgaggagacggttaaacagggccgcgggggggacgggcatgggcggcgagggcatcagctgggcctgactcagccgaccggtggcgtacagcggaggggcggctggggtgttcttgggacccccggctggcctggggggcggtggcgaaaccccgtccgcgtccgcaaacagatcgtcgaccaacaggtccatgggggcggttgggtccgggaataacgatctcgagaggcgaatgagacgtgcccgagcgcccggcggcggagagggggggagggatccgggacccgcgacagaaaaaggccggggccctcgcgaagggaatcgccgggggtgccgtgcgtccccgaggactgacatctcgcgtccaccaccccgcatttaagtatcaccccagtgccgccccaaacctcgtgacttccccaccgctccgggcggcccgtcccccgcgctcggaagggaggcgtgtccttcctcccgcccctcccgcccctcccgcccctcccgcccctcccgcccctcccgcccctcccgcccctcccgcccctcccgcccctcccgcccctcccgcccctcccgcccctcccgcccctcgccacaaacgcgtgctgacagcgaagtggttaaatcgaccgtgatgctttattgtctgtcgtctgaacgcggtcggggtcgctactcgagggggcggcggggacgggaagccgagcgggcgggggcccgtgcggtcgcggcggcacgccccgcggggcggccccgggcggccgcggtcgcgtcgacgtcctgcgccgcgtcgggattcaccaactcgttcgcgcgctgcaggaggttcttgccctcgcagaccgtcacgcgaatggtggtgaggtcgaggagctcgttgaggtcttcgtcggtgtgcggccgcgacatgtcccacagctgtaccgccgccagccgggcgtgcgtggccgccaggcgcccgaccgcggcgcagaagacgcgcttgttgaacccggccacccggggggtccacggcgccgtggggctcggtggggcggtgctgaagtgcagcttcttggccagtccctgggcgggtgtcttggttcttcccgaggccgtgggagcgggggcgtctaggagcacggcggagtcggcctgggcgggtcgcctgccgcgggcggggtcggtcgccggggtcgcggaggccttaggcgccccgcgcgtcattttgggggtccgcgcgggaggggcgtgcgagcgcccgccggcgcccacggggcccccggggggtggaggagcgcgcgcggggccggggccgtgagagcccgcgacggacgccgaacgacgcggtcgcgcggtatcccgggactcgtcgtcgtccgaagacgagtcccggtagagggcatacccagcctcgtcataatggagaaagcgaacctcgcccctcgggcgcgcgcgcatcgggccagcgccgcggcggaagtcgtcgcgcggactctctgggtccgccggggagaccgggccatagtacagctcctcgtgggtcccgcgcggcgcttcccgcggacacgacttgacggagcggcgagaggtcatggtctatcggagacaccggggacgcccgtgcggatcacagggaaggcgtcggcgaaggaggcagagagcgtcggaaggcggcgagggagggaaagagggagaccggcggggtacgggagagcagcgagggcctgcgtaacccacgggggccgcgggagtggctccctgcgggttgcgggggagagtttataggaagtggatataaccgcaggcgacgggactaaccaatccccgggggggcaacggacagacacgccccgaacaggcccgacttccgcgaggaagcaaaggccgggggccgcccaacgacacgcccaccccttcccaacagggcgggctcaggctgacccggcggccagtgcccgctgacatatctgatacacgtgcgcgatcatacatacgcccatcgaggtcatgcctagataaaagggcaccaggacccccgggacggacaccacaccggcgctgtcgccccggcattgcgcgtccccgataacgccgcgtgcgcctgccgcgttcggcggctccccgggcacgcccgcgacgagcgcgacgaacaacagcaccacccagcggcccagtcttgcgggtttccccgtcatcgcggcgatgagtcagtgggggcccagggcgatccttgtccagacggacagcaccaaccggaatgccgatggggactggcaagcggccgtagctattcgcgggggcggagtcgttcaactgaacatggtcaacaaacgcgccgtggattttaccccggcagaatgcggggactccgaatgggccgtgggccgcgtctctctgggcctgcgaatggcaatgccgcgggacttctgcgcgattattcacgcccccgcggtatccggccccgggccccacgtgatgctcggtctcgtcgactcgggctaccgcggaaccgtcctggccgtggtcgtagccccgaacgggacgcgcgggtttgcccccggggccctccgggtcgacgtgacgtttctggacatccgggccacccccccgaccctcaccgagccgagctccctgcaccggtttccgcagttggcgccgtccccgctggcagggttacgagaagatccttggttggacggggcgctcgcgaccgccgggggggcggtggccctgccggccagacggcgcgggggatcgctggtctacgcgggcgagctaacgcaggtgaccaccgagcacggcgactgcgtgcacgaggcgcccgcctttctgccaaagcgcgaggaggacgcaggctttgacattctcatccaccgagccgtgaccgtcccggccaacggcgccacggtcatacagccgtccctccgcgtattgcgcgcggccgacggaccagaggcctgctatgtgctggggcggtcgtcgctcaatgccaggggcctcctggtcatgcctacgcgctggccctccgggcacgcctgtgcgtttgttgtatgtaacctgaccggagtcccggtgaccctacaagccgggtccaaggtcgcccagctgctcgtcgcggggacccacgccctcccctggatcccccccgacaacatccacgaggacggcgcattccgggcctaccccagaggggttccggacgcgaccgccaccccccgagacccgccgattttggtgtttacgaacgagtttgacgcggacgcccccccaagcaagcggggggccggggggtttggctccactggcatctagaccgcgcctcgcgtcgggccagatggggccccggtcaataaagagctctgtttcgcatatgccctggtgttggcggttttttttgttgtctgtctgcccggcgctcggttgtccgttctgtcgtcgctatcacatacgcacaaacacacgggtagagtggaaccgaaaccggtcgacgtttattcaccacacagaaacacaagctaagcgagaaggaggggggcctcggtcgacgaggcctggcgtttgggggcggacgtgcgatgacgtgggtccggtgtagggtccgcggggggcacgggcccggggcgaacgggggatctgtcgccggcgtgggtgactgggaccgacgcaacctccggggcttgtgccctcgtaggcccggggggggcctcggtcgctccaagccccgcggtgcgggtccctccggccagagccgaggtggagagaccaagggcccgctccgcgatcgccacgtcctccatgaccacgtcgctctcggccatgctccgaatggcctgggagacgagcacgtccgccgacttgtccgcggcccccaccgacatgtacatctgcaggatggtggccatgcacgtgtccgccaggcggcgcatcttgtcccgatgcgccgcaacggccccgtcgatggtggagccctcgagtcccgggtggtggcgcgccagcctctcgaggttgaccatgcaggcgtggtatgtgcgggccagggcgcgcgccttcacgaggcgccgggtgtcgtccagcgactctagggcgtcgtcgagcgtgatgggggcgggcaaaagcgcattgaccaccgccagggcctcctgcagccgcggctccgcctccgagggcggagccgcggcccgaatcatctcatattgttgttcctcggggcgcgttccccaaccgcacagcaccccgagcagggacgccatcccggaacacgcgcgcggctctgcgccggctttcccccaccccaccccctccgggttcgcaggggcgatggggacggaagactgcgatcacgaagggcggtcggttgcggctcccgtggaggttacggcgctgtatgcgaccgacgggtgcgttatcacctcctcgctcgccctcctcacaaactgcctgctgggggccgagccgttgtatatattcagctacgacgcgtaccggtccgatgcgcccaatggccccacgggcgcgcccaccgaacaggagaggttcgaggggagccgggcgctctaccgggatgcgggggggctaaatggcgattcatttcgggtgaccttttgtttattggggacggaagtgggcgtgacccaccacccgaaagggcgcacccggcccatgtttgtgtgccgcttcgagcgagcggacgacgtcgccgtgctccaagacgccctgggccgcgggaccccattgctcccggcccacgtcacagcaactctggacttggaggcgacgtttgcgctccacgctaacatcatcatggctctcaccgtggccatcgtccacaacgcccccgcccgcatcggcagcggcagcaccgcccccctgtatgagcccggcgaatcgatgcgctcggtcgtcgggcgcatgtccctggggcagcgcggcctcaccacgctgttcgtgcaccacgaggcgcgcgtgctggcggcgtaccgccgggcgtattatgggagcgcccaaagccccttttggtttctgagcaaattcggcccggacgaaaagagcctggtgctggccgctaggtactacctactccaggctccgcgcttggggggcgccggagccacgtacgatctgcaggccgtgaaagacatctgcgcgacctacgcaatcccccacgacccacgccccgacaccctcagtgccgcgtccttgacctcgttcgccgccatcactcggttctgttgcacgagccagtactcccgcggggccgcggccgctgggtttccgctgtatgtggagcgccgcatcgccgccgacgtacgcgagaccggcgcgctggagaagttcatcgcccacgatcgcagctgcctgcgcgtgtccgaccgggaattcattacgtacatctacctggcccactttgagtgcttcagccccccgcgcctggccacgcatctccgggccgtgaccacccacgaccccagccccgcggccagcacggagcagccctcgcccctgggtcgggaggcggtggaacagttcttccggcacgtgcgcgcccagctgaacatccgcgagtacgtaaagcaaaacgtcacccccagggaaaccgccctggcgggagacgcggccgccgcctacctgcgcgcgcgcacgtatgccccggcggccctcacgcccgcccccgcgtactgcggggtcgcagactcgtccaccaaaatgatgggacgtctggcggaagcagaaaggctcctagtcccccacggctggcccgcgttcgcaccaacaacccccggggacgacgcggggggcggcactgccgccccccagacctgcggaatcgtcaagcgcctcctcaagctggccgccacggagcagcagggcacgacgcccccggcgatcgcggctctcatgcaggacgcgtcggtccaaacccccctgcccgtgtacaggattaccatgtccccgaccggccaggcgtttgccgcggcggcgcgggacgactgggcccgcgtgacgcgggacgcgcgcccgccggaagcgaccgtggtcgcggacgcggcggcggcgcccgagcccggcgcgctcggccggcggctcacgcgccgcatttgcgcccggggccccgcgctccccccgggcggcctggccgtcgggggccagatgtacgtgaaccgcaacgagatcttcaacgccgcgctggccgttacgaacatcatcctggatctggacatcgccctgaaggagcccgtcccctttccccggctccacgaggccctgggtcactttaggcgcggggcgctggcggcggttcagctgttgtttcccgcggcccgcgtagaccccgacgcctatccctgttattttttcaaaagcgcctgtcggccccgcgcgccgcccgtctgtgcgggcgacgggccctcggccggtggcgacgacggcgacggggactggttccccgacgccggtggtcccggcgacgaggagtgggaggaggacacggaccccatggacacgacccacggccccctcccggacgacgaggccgcgtacctcgacctgctacacgaacagataccagcggcgacgcccagcgaaccggactccgtcgtgtgttcctgcgccgacaagatcgggctgcgcgtgtgcctaccggtccccgccccgtacgttgtgcacggctccctgacgatgcgtggggtggcgagggtgatccagcaggcggtgctgttggaccgcgacttcgtggaggccgtagggagccacgtaaagaactttttgctgatcgatacgggcgtgtacgcccacggccacagcctgcgcttgccgtatttcgccaagatcggccccgacggctccgcgtgcggccggttattgcccgtcttcgtgatcccccccgcgtgcgaggacgttccggcgttcgtcgccgcgcacgccgacccgcggcgcttccactttcacgccccgcccatgttttccgcggccccgcgggagatccgcgtcctccacagcctgggcggggactatgtcagctttttcgagaagaaggcgtcgcgcaacgccctggagcactttgggcgacgcgagaccctgacggaggttctgggccgctacgatgtgcggcccgacgccggggagaccgtggaggggttcgcgtcagaactgctggggcgaatagtcgcgtgcatcgaggctcactttcccgagcacgcgcgggaatatcaggccgtgtccgttcgccgggccgtcattaaggacgactgggtcctgctgcagctgatccccggccgcggcgccctgaaccaaagcctctcgtgtctgcgcttcaagcacggcagggcaagtcgcgcgacggcccggacctttctcgcgctgagcgtcgggaccaacaaccgcctatgcgcgtccctgtgtcagcagtgctttgccactaaatgcgataacaaccgcctgcacacgctgtttaccgtcgatgcgggcacgccatgctcgcggtccgctccctccagcacctcacgaccgtcatcttcataacggcctacggcctcgtgctcgcgtggtacatcgtctttggtgccagtccgctccaccgatgtatttacgcggtgcgccccgccggggcgcacaacgataccgccctcgtgtggatgaagataaaccagacgctgttgtttctgggcccgccgaccgccccccccggcggggcatggaccccccacgcccgcgtctgctacgccaatatcatcgaaggtcgggccgtgtccctcccggccatccccggcgccatgagccgccgggtcatgaacgtgcacgaggccgtaaactgcttggaggccctctgggacacccagatgcgcctggtggtcgtcggttggtttctgtatctagcgttcgtcgcccttcaccaacgacgatgcatgttcggcgtcgtgagtcccgcgcacagcatggtggccccggcgacctatcttttgaactacgccggccgcatagtgtcgagcgtgttcttgcaatacccctacacgaaaatcacccgcctcctctgcgagctatccgttcaacgccagaccctggtgcagctgttcgaggcggatccggtcaccttcttgtaccaccgcccggccgttggcgtcatcgtgggctgcgagctgctgctccgcttcgtggccctcggtctcatcgtcggcaccgctctcatctcccggggcgcctgcgcgatcacacaccccctgtttctaacaatcaccacctggtgtttcgtgtccatcatcgccctgacggagctgtatttcatcctgcggcggggctcggcccccaaaaacgcggaaccagcggcccccagggggcgctccaaagggtggtcgggcgtctgcgggcgctgctgttccatcatcctctccggtatcgccgtgcgcctgtgctatatcgccgtcgtggccggggtggtgctcgtggcgcttcgctacgaacaggagattcagcggcgcctgtttgatctgtgacgtaacgcctcttccgttggaagaggcggacccagtcgcccatgcaaattaaatacacgacccgcctcgggcctacgcaccctcgcacgtcgcatgcaaattaaaatcgtgcacagagccgatccggcctcgggtctgcttgcccctcccccggcccagcacaggcaggctcgtccgacttccgcatacaccccaccctaccgcgtgcttccgcacccccgcctacgcgtgtacgcgaaggcggacccagacctgccgtatgctaattaaatacataaaacccaccctcggtgtccgattggtttctggggacggcgggggcgggggcggtgacgcccgacggggagggacaaggaggagtttcggaaagccggccccggtcgtgcgggtataagggcagccaccggcccactgggcgctgtgtgctgccgtgtgccgaccccggttgcgcgtcggtgccgctcctcgattcggacccggccactctcttccgacacgcgccccctcggaggacacccgccatcccagccccggcgacctacaacatggctaccgacattgatatgctaatcgacctaggattggacctgtccgacagcgagctcgaggaggacgctctggagcgggacgaggagggccgccgcgacgaccccgagtccgacagcagcggggagtgttcctcgtcggacgaggacatggaagacccctgcggagacggaggggcggaggccatcgacgcggcgattcccaaaggtcccccggcccgccccgaggacgccggcacccccgaagcctcgacgcctcgcccggcagcgcggcggggagccgacgatccgccacccgcgaccaccggcgtgtggtcgcgcctcgggaccaggcggtcggcttccccccgggaaccgcacggggggaaggtggcccgcatccaacccccgtcgaccaaggcaccgcatccccgaggcgggcggcgaggtcgccgccggggccggggtcgatacggccccggcggcgccgactccacaccaaacccccgccggcgcgtctccagaaacgcccacaaccaagggggtcgccaccccgcgtcggcgcggacggacggccccggcgccacccacggcgaggcgcggcgcggaggggagcagctcgacgtctccgggggcccgcggccacgaggcacgcgccaggccccccctccgctgatggcgctgtccctgacccccccgcacgcggacggccgcgccccggtcccggagcgaaaggcgccctctgccgacaccatcgaccccgccgttcgggcggttctgcgatccatatccgagcgcgcggcggtcgagcgcatcagcgaaagctttggacgcagtgccctggtcatgcaagacccctttggcgggatgccgtttcccgccgcgaacagcccctgggctcccgtgctggccacccaagcgggggggtttgacgccgagacccgtcgggtttcctgggaaaccctggtcgctcacggcccgagcctctaccgcacattcgcagccaacccgcgggccgcgtcgacagccaaggccatgcgcgactgcgtgctgcgccaggaaaatctcatcgaggccctggcgtccgcggatgagacgctggcgtggtgcaagatgtgcattcaccacaatctgccgctccgcccccaggaccctatcatcggaacggcggccgccgtgctggaaaacctcgccacgcgcctgcgcccctttctgcagtgctacctgaaggcccgaggcctgtgcgggctggacgacctgtgctcgcggcgacgcctgtcggacattaaggatattgcctcctttgtgttggtcatcctggcccgcctcgccaaccgcgtcgagcgcggcgtgtcggagatcgactacacgaccgtgggggttggggccggcgagacgatgcacttttacatcccgggggcctgcatggcgggtctcattgaaatactggacacgcaccgccaggagtgttccagtcgcgtgtgcgagctgacggccagtcacactatcgcccccttatatgtgcacggcaaatacttctactgcaactccctattttaggcaagaataaacatattgacgtcaacccaagtggttccgtgtgatgttcttggcgcgcgcggcgggtggggcggagactccggggcgatgccggcgtgcgcgtgggaggagggcgatgacccaccggataaatgtggggccccggcccggcccgcttcatagcgcgtccaggaactcacggcagacgcgtattcaccgacccccccctcgcaacatgacaacgacgcccctctcgaacctgtttttacgggccccggacatcacccacgtcgcccccccgtactgtctgaatgccacgtggcaggccgaaaacgccctgcacacgaccaaaacggaccccgcgtgcctggccgcgcggagttatttagtccgcgcctcctgctcgaccagcggccccatccactgttttttctttgcggtgtacaaggactcgcagcactcccttccgctggttaccgagctccgcaacttcgcggacctggtcaaccacccgcccgtcttgcgcgaactagaggataagcgtggggggcggctgcggtgcacgggcccattcagctgcggaaccatcaaggacgtctccggtgcatcccccgcgggggaatacacgataaacggtatcgtgtaccactgtcactgtcggtatccgttctccaaaacctgctggctcggggcatccgcggccctacaacaccttcgctctataagctcaagcggcacggccgctcgcgcggcagaacagcgacgccacaaaatcaaaatcaaaatcaaggtataacccacccccttccctccgagtccgtatgcaacctcattaataaagagtgagaaccaaccaaaacagacgcggtgtgagtttgtgggttataggaacccggtaaataccacgcgacgaaccagcatgtgtgttaacgcaacttttattcgttgtatcgcgggaggggggaagcttaccgccaaaggaaggccaagatgataacgacgaccaccgcgaccaccccaaaaaccgcatgacgacacgtcccgccacaccaccctggggcttggggcgtgtcggagctcgacgcacagcgggccgcgcgttgggcccggtacagctctcgcgaattgacaagcgggggtcgccacgtgcgcgagctttgcacgcggggttggtcggccggccccacggacccgcccggtggctcggtcggacatgcggccatgaccatggcgtaggtgggggggcgatccgaggtcgcctctgcgtaagtagggaggcccgacgggaggtcgcctcccacgccagggtgggccccaatcatagtttccggtagaaacaggggggtctccacaaacaacccccctgggccaaagctccggcgccgcgcccgtcgttcggcgcggcgcctggcgcgccgagcggcccgccaggcggcgcggcgcgagcggccacgctcacacacctcgccgtcaccggaagaagccggtgaaacaagcccaaccggcgacgtccctgcagagtacggtggaggcgagtccgtgggggtgtcgatatcaataacgacaaactggcccgcgctcgcgccggccacactctcgtatgggggcggggcgtcaatcacgctatcatctccgtcatccctgcatgcgtgggcatgcccagcccccaacgccatggtggggattcgcggctcagaagcctgcatgtcgtgtggtcggtcgtagtccaacgtgcctcccccacccaccacacagccggtccccacgccgaccactagaccgcagacgtcgcccaaccgaggtccccgtgcacagaccgcgccttttatagccccaggggttgctaattaacgcacgcatgcagacgcaatttattttgctcccccgcgtcctcccctcccctgcgcacacgtgataggtcttgggaacccgaggggcgacgcggggaaagcgcgcccccgcccggccgccgcgcgcccccgcccggccgccgcgcgcccccgcccggccgccgcgcgcccccgcccggccgccgcgcgcccccgcccggccgccgcgcgcccccgcccggccgccgcgcgcccccgcccggccgcccgcgtcgcgccggcgccccctcccggcgcttccggggtctttccttccttccccgccgcgaccccggccccgccccaccgccccgcccggcaggggggccccggcgccgcgcagaacacacagacgaacacacggtggcgatcttttctttacttcggcggaccagcgagccccggccccggcccgcgccccgccgccacacccacggcaccccccccccgccgcccaccccggggtccacacaggagcgcgcgggcggcagaaacgcgggcgcggcggcggtcggggtgggagtggtggtgggggacacgaaaacacacccacgacactctccccccaccccgaccgccgccgcgccccaccggcgggatcgcggcgagacgcagccgggcccccccccaccacccgcccacccacctaccccgcgcccgcagcctccggcagcacgccgaccaccgccgccaccccccaaacagccaaggcgcggtggggggcgtggtggtgaacgatggggggaacacgggggggaggggtccggggcgaggcgggcgggcgaaggaagggggggtggtggcggcggcggtggaaagcggaaaaacggaggatggaagggcagaagatggggagtcccgatcctcctcctgcatcccctcgccttccattctccggccctccgcgagtcccgacgccccccccccgccgcccgacgaaggagacccaagcaccgcagccggagaggccgagcggggagtgggcggccgggcgggaggatggcggagagagagagagagagagagagagggggggggggggagagggaaagcaacgggaaagagaggcgcgcggaaaagcagcaagaggggggacggggcgagccgggcagagtgcggagcccccggagcccgcggccgcagccgagcagcgccgcgggctccggggccgggccgggccggcaacgccccgcgccggccgcggcggagagaacccctgtgtcattgtttacgtggccgcgggccagcagacgggccgcgggccagcagacgggccgcggcgccagcggcccacgcctcccgccgcattaggcccccgcgggcatccggcggccggccccacgcccttccattaaacactcccacgttgggggggggcgcgccagctgagtgctctgcggttgcgggcgccgtgcccggagatccattaagccgccggagagcccgagccccgcccgcgtgttgctgtgggcatttctgctgcgtcatccctgtctttataaaaccgggggcgcggcagcaacgaacgcaggggcccgccgccgatcgagagggactccggagaaggaaggctgctccgcgcaccggcgcgcccttctcctctcccctccctacctccccctctcttcccccttttttcccccgcctcccgtcttcttccgcgcctccgagggtccgcctctgcctcggggacccccgggcgggccggggcttggccgccgaggtgcgccccggccggaggggcccccgcacctcggcggccgccccctccggcgccgcgcgttcgcgaaaggcgcgaaaggggcccccggaggcttttttcgattcccggccgggggtcccgggtagccgcccggcgccgggcggaaggcgtcccccgcccggcggtccggcccgggcccccggcggagcgcgggggccccggggccccgggccgcgccggcggcgtttccgcgttccgtttcttctccctcccggccgccccgctcccgggcccgaccctcgccccttcccttctcctcgtcttcccccgtcccgccgcgccccttccctcttccttctctctctctgtctcgctctcctcacatttcccccccccccccgccgccgccgccctctgcccgcgtcccaccgagacgccgcgccgcgtgagccgtccgccgggggacccaggctccggggggggggggcgcctgcgtgtgtctcgtgtgagagagcgcgcccctcgaacgccgcgcgttctcgcaggtaggtttagggtcgtacaggtgagcttctgctgaggcggcgggagagggggggggggcgggcggaagagagaagagagcaggggttgggggagaactgttcttcctccccctttcaagaaacacgaggcgggggtcccagaaagggcaggcaggtcagccgcaccgcccgcgagccaacccgtatcctttttttctaggtgtttttgtttttgtttctgtttttgtttgttttgttattattttcgcggatccggcgtgttcggatccaccccccctttctccttcctcttcccttccacccacccccgtttcccccccccgtggtgtcgtccgggggcgtcgttcccagggggggcaggcgcgggtcgggcccatacgcccaccgcccccacgcgccggtcacccccccccaacaaccccaaaggcgcgtgcccagccacagccgtgggtgtggcgcccgtccccttcctctaccgcgtgggcgcgggcgggggggtggtggtagtggtggcggaaggaaacgggccgggggccggggccgctagggaaaggtaggcacgcgcgcggtgtgtcgacttgcatgccccgcaaaacgcgtcgtgtcgtgttgtgtcgtggtgggccgtgttgtggtgggccgtgtggtgtggtgtggtgttgcgaacgcgcgagccccctcgccccgatgggagtctccccgcagccagggtaaggaggggcgggcgtggcgggcaggtgtgcgggcggggtggggtgagtgcggttgcatgcctcgggtctcctcttcctgctcctcctcctttctcccagccagggtgaggaggggcgggcgtggcgggcaggtgtgcgggcggggtgggcgccggggcgggggtgggcacgggcgtaagtgcgggtgcatgcctcgggtcttctcttctccctcctccttcctcccacccgtccccgggggcagagggcgtgcatgcgttgtgattcaaccgccctcgcccccgccccactttccccccctctctatcaaagttccctggcccctggcttcgcgccggtggtgcggctgaccccccccctcctccctccccgagccaggcgccctcccactcctgcccaccacccccagggtctggccggccagacgtgcgtgctctgcacgatcgggcccccctccctgtcaacacggacacactctttttttacccgccagccagcccgcccacccaccaagacagggagccagaacgcaggccgggccccggctctgttctatcataaagaccaacaggcctcgggggtgggggcggcttctcgtgcccgccccccctcctcctcctccctttccccccccccatccccggcccccctgcgcgggggagctgcatcaaaggccaacaacaaagtgtgtcaaaagcatcacaaaactttattgtaaaatttttataaatataaagttttttttcctcaagttttcaacaaggccagaaagtccataacaaaatgctggtgtgtgttgctgttcggggccgtgtccgtccccccccactcccacccccacttcctgtctcctccccgtctttcccccccacctccccctgcccccgaggcgcctcggccggtggtccggtggggggcggcttccctttgggcagcaagccgagtgttagctccccctactccccgtggcccgcgggggcgtcgccggccggcgcgggcgcgccctgctcccgagaccacgggtggcgcgaccggaggccgtggaagtccagcgcgcccaccagggtgccctggtcaaagagcatgttgcccaccggggtcatccagaggctgttccactccgacgcggggggcgtcgggtagtcggggggcctcacgcagttgcgcgcgtgctcggggagcagggtgcggcggctccacgcgggggccgcggcccgcagcaggtccgccacgttccccgtctggtccacgaggaccacgtaggcccctatgtggcccgtctccatgtccaggacgggcaggcagtcccccgtgaccgtcttgttcacgtaaggcgccagggccacgacgctcgagacccccgcgatgggcaggtagcgcgtgaggccgggcgccgggtcgcgggccccgggctcggggccgccctccgcgtggcgcgtcttcctggcacacttcctcggcccccgcggcgcagcagcgcgggggccgagggaggtttctcgtctctccccagcgccggacgcggacgcgacgctcccaccagccccgcccgcagaggaagaggcggaggaggaggaggaggaagaggaggcggcggaggaggaagaggcggcggaggaggaagaggaggcggcggaggaggaagaggaggcggcggaggaggaagaggaggcggcggaggaggaagaggaggcggcggcggcgaccgcggcctgggacgacggagacgccgacgggggcgcggcgcccgcggacgccggggcgagcggcccgtggccgcggtcgcccgagtccgagtccggggcccggcgcggcgccgccctcttggcccccaccccctggggggcgaggggcgagcgcggggcggcggaggaagaggcggaggacgaggccgcagggcccgagtccgacccgcgcctcttccgggggcgggccgccgccccctccgcggcgtggggggcggcaccgggggtgttggtgccgcgggggaccccgggtcctccctccgcgcccggccctcccgacccgcgcgcgtcggtcgcgcctgcccggcccagactctgtgcttgggtgtcggtctgagcctgggtcatgcgcgaccggggcgcgcggtgcgcgtccaccggcacggcgggcggcgcgggcccggccgcgtccgcgctcgcagacaccacgggggcggcggcggcgcggggcggactccggacgcgcggggcgacggccgcgcgggggcgcgccgcgcgccccgacgactgtggcagacctccccccccggggcccgaggacacctgcgcggaggaggaggagaaaaaggagagcggcccggggcccgcggggcggcgcggagacggcgggggagagtcgctgatgactatggggggctcctgggccgcgcggggctgtcccgcggggggcgtcctgccctccgccgccgcggcgtcttcgcccacccgccgcgcctgcgcgcgccccccgccggccgcagggggaagagaggccactctcggcacgacggccgcgacggcagggccgcccccagacccagatcccacccccgcccgcaacggggcgccgccgctgctgctgctccgcggggcgccagggggcgccggtcgggtcgcggcgggctgggaggttccgcgggtcgcccccgcaccgccgcccccgcgccggggcgctcttcggggggcgggcgggacgtagtccactgcagagggagacagagacgggagcccccggttagtgcccgacccccgcccgacccccgcccgacccccgcccgacccccgcccgacccccgcccgacccccgcccgacccccgcccgacccccgcccgacccccgcccgacccccgcccgacccccgcccgacccccgcccgccctcaccgtcggccaggtcatcgtcctcgtcgtccgtgccgggccacgggggggtgggcgacagggcgcggaccgtgtgtccccccagcgacagggagcgcggggccgtccgctggttgcccgtccagataaagtccacggccgtgccggcccgcacggccgcctcggcctccacgcgggtccgggggtcgttcactatcgggatggtgctgaacgacccgctggcggtcacgcccactatcaggtacgccaccggggtgttgcacaggggacacgtgttgcgcaacggaatccaggtcttcatgcacgggatgcagaaggggtgcaggcagggaaaactctggcagcgcaggggcggggcgatctcgtccgtgcacacggcgcacacgtcgcccccccctcccgcttccgcttcctcctcacccacgggcccacccccgcaggatccctgcgcgtcggcgggcgtggggctgccctggcgctcggccgggggccgggccgggggcgtggccgcgtccatcaggcccgcctcgaacatctccgtgtccgtgctgcccgcctcggaggtggagtcgcggtgaaggtcgtcgtcagagattcccacctcggtctcctcctccgagtcgctgctggcgagccactgcatgtcgttgagcatcccccaggcgtgcggggcggcgggctgcttgacaaagcaacgggggggatttagagggcgcggggcgtgaggcgggacccccgcgccgtgtcccccgtgtccctccctcaccccggccccccgcccgctgctttttgttcggaagggggggagaaaggggtccgtaaccaaaggtggtctgcgtcctttggattccgacccctcgtctccccccctgtcccccgctctcgggctcctccctgcctccctcgcccccccagagggtcggggggcggcgcacggcccacgggggtcccccgaccgcttaagcgggccgggggtcggccccgtcaagcgtccccgcccccgagcccaccgcccgcgaccacccccaacccgcagccgggtggtccggggaaaagggggggcctgagacccgggggtcgccctctcaccgtgccgggggtctgccgcggcggccgctcggggccggggtccgcccgggagctcgtgccgggccggggttccatgagccggggtagggtagactcgagacggcggcccgcggtctctctcttgccgggttttagtctctgtctctccgggtctcctcctcccgccgggccgccgctccgtcgctcgcagtgccggggtgcgaatgcggcccgaccgtcacacggggctgccttatacccggcgcctatccactcccccaaaggggcggcatttacgattcccccaatagccgcgcgccccggcgggggcggagggagggaatccccccctctcggggcggccccgtccccggggaccaaccgggtgtactccaagaaccccattagcatgcgccgccccccgccgacgcagatgggagtccccccggcgccccgccggcgcggccctgagtggtgcccgcccccggggagaaattcattagcatactaggaagcccaggggaccaataggggccgatcagcccacccacccggcggcgcgcgaggctctgcgtgttctgccaagaaagtaatcagcataacccggaaccccgagggagtaattacgcggggagcgaggggccgtccgaacgtttttaattaccataagcgggaatggcggcccgttaaaagctgctaattaccgcgagcgggaacgccggcccattaaaagttgctaattaccatgcgcggggatggcggccgggaccgcctattaaaagtttctaattaccataccgggaagccggtctagaggatccccgggtaccgagctcgaattcatcgatgatcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggatccatggaaagggtccaacccctggaagagaatgtgggaaatgcagccaggccaagattcgagaggaacaagctattgctggtggcctctgtaattcagggactggggctgctcctgtgcttcacctacatctgcctgcacttctctgctcttcaggtatcacatcggtatcctcgaattcaaagtatcaaagtacaatttaccgaatataagaaggagaaaggtttcatcctcacttcccaaaaggaggatgaaatcatgaaggtgcagaacaactcagtcatcatcaactgtgatgggttttatctcatctccctgaagggctacttctcccaggaagtcaacattagccttcattaccagaaggatgaggagcccctcttccaactgaagaaggtcaggtctgtcaactccttgatggtggcctctctgacttacaaagacaaagtctacttgaatgtgaccactgacaatacctccctggatgacttccatgtgaatggcggagaactgattcttatccatcaaaatcctggtgaattctgtgtcctttaactcgagctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccaggttatccgtgtaaccgccagtccgtgcttgcctagcgaactcacccgtcccggctggcgtgcgcagcccgggccgtgttgcgggccctcttaaggggcggcggcaggacggggactcccgccccgcctcttttcccccggggagtcaacccccggggggggtgttttttgggggggggcgcgaaggcgggcggcggcggcgggcgggcggcagggcagccccgcgcgcccccttccccgtccctcccccggagccggccgctcccccgcgggcgccgcccctccccccgcgcgccgcggggctgccttcccgcgggcgcccccgcgcggcttttttcccgcgcccgcccccgcgcggcaagacggggactagcaggctgtgccgcagaccaccacacactcccaagctccccgcccccccgaagacgccagtcgcaccaccgctcgccctcgcagaccagacagttgcaccaagcacccgcccgcccgcacacggttccccgccaccccctccctcccctccatcccgccgagctcgcggcagcccctcccccccgcgcgccacggggctgcggtcccgcggccgcctcccccgcggccgcctcccccgcgccccgccccgggggcttcccccgcccctccccccgcgcccgcggccccgagctcgcagcagcccctccctcccgcgccccgtgccttccctcccgctcctgcgggggggctcgggccacctgaccttcgtaacctgcactcaggtcagagccccagaccccccgcgggcgcgggagacgtgccgcccacccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgaataaaccacacaaggcggtacgttttcgtctgtctcgttctttatttctcacacacgcgcgcggccatcgccgcgtctgtcttaaaggcgcacagacgcccgattccttccccctctccccatctcccccctcccccgctcccggaagtttcccccccgtcactccccaaacagtccgtcgtcgtcgtcctccagctccgcgtccatgtccacgggctcgcgcctcggcggcgtggccagccccgcggcggtccccaccacctccacgccgccgcccgccgcggccagcaccgtccccgcgcggcccgcggccgacgcccagcgtatctgcgggggcgggcccgcgtccgcgtcgtcgcgcagcaccagcgggggcgcgtcgccgtcgggctcgagcagcgcccgcgcgcagaactcccgccgcggcccgcgcagctccgccgggccgccgcgcacggcgtcgcgccccagcgccacgtagacgggccgcagcggcgcgcccaggccccagcgcgcgcaggcgcggtgcgagtgcgcctcgtcctcgcagaagtccggcgcgccgggcgccatggcgtcgcccgcgcccgaggcggcggcccggccgtccagcgccgggagcacggcgcggcggtactcgcgcggggacatgggcaccagcgtgtcggggccgaagcgcgtgcgcacgcggtaccgcacgttggccccgcggcagaggcgcagcggcggcgcgtcggggtacaggcgcgcgtgcgcggcctccacgcgcgcgaagacccccggcccgaacacgcggccggaggccagcacggtgcggcgcaggtcccgcgccgccggccagcgcacggcgcactgcacggcgggcagcacctcgcaggccaggtaggcgtgctgccgcgagaccacgggcccgtcggcgggccagtccgcggcgcgcacggcgttgacgacgatgaggcggcggtcgcaggcgccggccagcagccccaggaactccacggcgccggcgaaggccaggtcccgcgtggacagcagcagcacgccctgcgcgcccagcgccgagacgtcgggggcgccggtccagttgcccgcccaggcggccgtggcgggcccgcagagccggttgcccagggccgccagcaggcaggacagcccgccgcgctcggcggaccactccggggggggcccgcccccggcgcggcccgcggccaggtcctcgcccggcagcggcgagtagaggatcaccacgcgcacgtcctccgggtcgggcacctggcgcatccaggccgccgcgcggcgcagcgggcccgaggcgcgcagcgggccgaaggcggcgggcgcgccgccggggggcggggcggcgcagcgcgcggccagcgaggccagcgcgcgcgggtcgaacatgagggccgggcgccacggcgcggggaagagcgggtggtccgtgagctcggccacggcccgcggggcgcagtaggcctccagggcggcggccgagggcgccggcgtgtggctgggccccggcggctggcggcgccagccgccctgcgggtcggggccctcggcgggccggcgggtcagcgccgcggggcgcggcggccgcggcggcggcgtcggcggggcggggggcgcggcccccgcgggaggggcggccgcggggcggggggcgtccgcgcggctcttcttcggggggcgcggggcgccgcccggcggcgccctggccggggcggggctcttgcgcttgcgcgcctcccgcggcgcggaggcgggcgcggcgagcgagtcggccgcggcgacggtgtcggccagcagggggcgcaggctctggttctggaagagcaggtccgcggcggcggcggcggcggagctcagcaggcgcgggctccgcggcagcgccgggcccagggccccggcgaccaggctcacggcgcgcacggcggccacggcggcctcgctgccgccggccacgcgcaggtccccgcgcaggcgcatcagcaccagcgcgtcgcgcacgaaccgcagctcgcgcagccaggcgcgcaggcggggcgcgtcggcgtgcggcggggcggccgcgcccgcgggccccgggcgcgggggcgcggcgggccgggctccggccagccccggcacggccgccaggtcgccgtcgaagccctccgccagcgcctccaggatcccgcggcaggcggccaggcactccacggccacgcggcccgcctccgcgcgccggccgccgccaccaccgccggcgccgtcgtcgtcgtcgtcgtcgtcggccccggccggcgcggaggcgggcgcggcgctcaggcgccccagggcggcgagcacccccgcggcgccgtagccggcgggcaccgcgcgctcgtcggccggcgacgccgccgccgacggcaacggggcggcggcggcggcgggcttcccgcgggcgtcgtcgccgtcgtggcggttggcgtcgccgccgtcgtcgggggttcgcgccccggtcagcgccgcgttctcgcgcgccagcaggggcgcgtaggcgcggcgcaggctggtcagcaggaagcccttctgcgcgcggtcgtagcggcggctcatggccacggcggccgccacgtgcgccaggccccagccgaagcggcccgccgccatggcgtaccccaggtggggcacggcccgcgccacgctgccggagatgaaggagctgctgttgcgcgccgcgcccgagatccggaagcaggcctggtccagcgccacgtccccgggcgccacgcgcgggttctggagccaccccatcgcctccgcgtccggcgtgtacagcagccgcgtgatcagggcgtactgctgcgccgcgtcgcccagctcgggcgcccacacgggcgccggggcgcccgaggcctcgaaccgggcccgcgcctcctccgcctcgggcgccccccagaggccggggcggctgtcgcccagcccgccgtacagcacgcgccccgggggcggggggccggccccgggccacggctccccgctgacgtacccgtcgcggtagcgcgcgtagaaggcgccggaggccgcgtcggcgtccagctcgacccgccggggccgcccggccgtgaagcggcccgtggcgtcgcggccggccaccgccgcgcgggcccggcggcgctccaggcggcccgcggtcgccgcgggggtccgggccggggcgggctcggccctgggcgggctcggccggggcgccgcccccggggccctcgcgggcacccccgcctcctcgtcgtccgcgccgagggtcccgcccgcggcgtggtctgcggcgctggcgggggcgcgggcggcgtcgtcgtcgtcgtcgtcgtcagacgaggaggcggatgcagacgaggaggaggaggcggaggaggaggcggaggacgccgacgacgaggatccggattttgatgagtcagaggcggccgagcgccggcggggggcgcgccggcggcggtggtggtggtggtggtggtgtcggcggggcgccgggggtcgcggcgacaggctggccatggggtccgggtacgccccgcggaccgcggacgtcgtctccggtccgcggacccagcggcccgcgtcgcggtcgtcgtcatcgtcgtcgtcgtcgtcgtcgtcgttctcctcgccataatcggcgcgcatggagggggtccgcggcggagaaggcgagcgggccgcttcttcttccgcgccgtcgcgctccggggggggcgacgggatcgtgcgaacggcctcgtccaccatcgaggccagcagggccagctgccgcggcgagacgacgccgtccgcggcaggctcgtcgacggcctccccggacgccggggccgcctcgtcggcatcggcatcggcggcggcgtcgtcggcctcgtcttcgttctcctccggcccaccgtgccacccgaacccgggccgcgcggcggggcgacggtccgggttcggggtgggcggcggtccgtcggctggatccggagatccggggccgccggtcgtctccgccgcggcccggagacgtcccccgtcctcgtccgccatcgcgacctcggccccgcggccctgcgtcgtcgtcgtcgtcttcttcttcttccgctgctccgccgacatcgcctccgaccggggtgtgcgggggggggtcttcttcttcttcttcaggggcggcagtgggggggggtggttggcagtctctctcccccccgtgcggtgcgtgcgtgtgcctgtgtcttttcgcctctccgcgccgatcgggtagatcctggcggccgcgtcggtagccgcgctccgtgtggacgatcgccccgtcgcctggctgatatagtcctcggggcgcgcggggcggggggaaaggaggaggacgcggaggaggagcgatcgacgccgccgcgccccggctcgccggggttccgcccccaggtggaaccgcattatgcgcggccccgccccgacgcccgcgcgtccgcgtccgtggcggcggcccgttggtcgcgccgccgccggctccgcccgcgcggcatctcattagcgcccggcgcgggcggcttccgcttccgcccgcgatgctaatgagaccctcgtcgcgggcgggctcgctcccctgcccttccgggttcgtggtaatgagatgccggccccgcgctcccgttggcccccgccggccccaaaggggccggcgaggtcgccccgttggtccgcgggcggctccgccccaaagggggcggggccgcagggtaaaagaagtgagaacgcgaagcgttcgcacttcgtcctaatagtatatatattattagggcaaagtgcgagcgctggcgccctgcccggggcccgcgtcatcccgcgggctccgccccaaagggggcggggccgcagggtaaaagaagtgagaacgcgaagcgttcgcacttcgtcctaatagtatatatattattagggcaaagtgcgagcactggcgccctgcccggggcccgcgtcatcccgcgggctccgccccgaggcgggcccggacggggggcgggccgttcctcgcgcacataaagggccggcgtcccggtcgccgccgcaccaggggcacaccggctgcgcggcggagaccgggacggcagcggcggcatcgcgaagggggccacagcgagacagagacgccggcggcgagcggggcaccgacgcacccggatcggatcggatacagagacgcgggcgcatcggttccttttcgttctgcctttccctcccccccccccccccaccctgtacgtaccgcgaggacccatccacccactgcagccttatcgcaggtacggtgacccggggggccgggccggggggacgggccggggggacgggccggggggacgggccggggggacgggccggggggacgggccggggggacgggccggggggacgggccggggggacgggccggggggccggggggccggggggccggggggacggggggacgggccggggggacgggccggggggccggggggacggggggacggggggacggggggacggggggacggggggacggggggacggggggacggggggacggggggacggggggacggggggacggggggacggggggacggggggacgggccggggggacggggggacgggccggggggacggggggacggggccccgatcccaacatccgcgctttctcgcaggccgggcgccgccttcgtggacgggacaccggtgtggtaactggcgacaaggcgttgccactatggcagacatccccccggacccgcccgcgctcaacacgacgcctgcgaatcatgctcccccatccccacccccgggttcacggaagcgcagacgccccgtcctccccagctcgtcggaatctgagggtaagcccgacacagaatcggaatcctcctcgaccgagtcgtccgaggatgaggcgggagacctacgcggcgggcgccgtcgctccccgcgggagctcggggggaggtattttttggatctgtcggcagaatcgaccacggggacggaatcggagggaacggggccgtcggacgacgatgatgatgatgcgtcagacggctggttggttgacacacccccccgcaaatccaagcgaccccgaatcaacctgcgattaacgagctcccccgaccggcgtgcgggtgtggttttccccgaggtgtggagaagcgacagacctatccgcgcggcgcaaccccaggccccggcccagtcttccggggatcgcgcagccgcaccgcggcgctctgctcgccaggcccagatgcggagcggagccgcctggacgcttgatctgcattacatacgccagtgcgtcaaccagctctttcggatcctgcgtgccgccccgaacccgcccggcagcgccaaccgcctgcgccacctggtgcgagactgctacctcatgggctactgccggacccgcctggggccgcgcacgtggggccgcctgctgcagatctcgggcggaacctgggacgtgcgcctgcgaaacgcaatccgggaggtcgaggcgcattttgaacccgccgccgagcccgtgtgcgagctgccctgtctgaacgccaggcgttacggccccgagtgtgatgttggcaatctcgagaccaacggcggctcgacgagcgatgatgagatatcggatgcgacggactcggacgataccctcgcgtcccattccgacacggagggggggccctccccggccggccgggagaacccggaatccgcgtccggcggggctatcgcggctcggctggagtgtgagtttgggacgtttgactggacgtccgaggagggctcccagccctggctgtccgcggtggtcgccgataccagctccgccgaacgctctggcctacccgccccgggcgcgtgtcgcgcaacggaagccccagaacgcgaggacgggtgccgaaaaatgcgcttccccgccgcctgcccctatccctgcggccacacatttctccggccatgagcgcgggacccccagcccggtgtgtttgccaaacgaaaaataaacgccctacaagaaagcttttgtgtctgagtgtctggtttttctgggggtggaggaaggaacgacaaaaaaaagaaacaaacgcgacaccgctcgtacgtgtaatggggcgcagtgttttttattagcatcggggggggttagaggttggtgattggatagcaaacgtgggatgacggaggccactcgtcgccaacggccagcgggggcccggggttctgggggtcatcgtcccccgtctgccaggagggctcatcgggaatctcgggtcgccccatgcacgtaaaacacgggcgctgcgtggggtgggtcgccggatgcgggcgggatgatgcggggcggggtttgttgtgaggagccacgagggaccgtagccagcgaagacagctgcgttcccggtcgccgggcaccaccacgccgtattggtattcgtatcggctaaggagattttccagggggtgattaggcgctgcggggaacggggtccacgacacggtccgctcgggcaaaaaccgatcgggcaggggccacggttcccccacccacgcgtcgttggtcttcgtggcgatgaagcgaaaccccagccgggttttttgtgcgtactcgaaaaacggcacacacaggtccgccgccccgaccacccacaggtggtatagccggtgggggccggggcgctcttgatgcaggagccgaaaacacgcaggggcatccagaatctcgatgctttccagggggtcgtcctccgcaaacaggcccgtcgtggtgtttgggggacagcgacaggagcgggttcgcacgatcggtcgggtgaatttgggcaagtccatcagaggctcggccagcctgcgaaggttcgccgggcgaaccaccaccggggttcccagaggctcggaggccaggatccggcattgccgaagcagaaaactccacagagccgggcttgcgtcagcggaagtccgcggcagggcgtttcgttggtctaggagggtaaccacacttacaacaacaacgcccatgtcggtatattaggcccgtggtccgatcttcactcactcgcctgtctgcggacctatgcacggcgggacggcgcgcggacccgggggggctgcttgctatcacacggcccgttcgcacgttcgattttttcagccttgtttggttggctaggtatcccggataatctgacgttccggatatagggggcggggggtagtggggggtgtgtcgacaaactgccgcttcttaaaacaccggggcccgtcgctcggggtgctcgttggttggcacgcgcgacgcggcaaatggcctgtcgtaagttctgtggggtctaccgtagacccgacaagagacaggaggcgtccgtcccgccggagacaaacacggccccggccttcccggcgagcaccttttatacccccgcggaggatgcgtacctggcccccgggcccccggaaaccatccacccttcccgcccaccgtcccccggcgaggctgcgcgcctgtgtcagctgcaggagatcttggcccagatgcacagcgacgaggactaccccatcgtggacgccgcgggtgcggaggaggaagacgaggccgacgatgacgccccggatgacgtggcctacccggaggactacgcggaggggcgttttctgtccatggtttcggccgcccccctgcccggagccagcggccatcctcctgttccgggccgcgcagccccccccgacgtccggacctgcgacagcggtaaggtgggggccacggggttcaccccggaagagctcgacaccatggaccgggaggcacttcgggccatcagccgcgggtgcaagcccccttcgaccctggcaaaactggtgaccgggctgggattcgcgatccacggagcgctcatcccggggtcggaggggtgtgtctttgatagcagccacccgaactaccctcatcgggtaatcgtcaaggcggggtggtacgccagcacgagccacgaggcgcggctgctgagacgcctgaaccaccccgcgatcctacccctcctggacctgcacgtcgtttctggggtcacgtgtctggtcctccccaagtatcactgcgacctgtatacctatctgagcaagcgcccgtctccgttgggccacctacagataaccgcggtctcccggcagctcttgagcgccatcgactacgtccactgcgaaggcatcatccaccgcgatattaagaccgagaacatcttcatcaacacccccgagaacatctgtctgggggactttggggcggcgtgctttgtgcgcgggtgtcgatcgagccccttccattacgggatcgcaggcaccatcgatacaaacgcccccgaggtcctggccggggatccgtacacccaggtaatcgacatctggagcgccggcctggtgatctttgagaccgccgtccacaccgcgtccttgttctcggccccgcgcgaccccgaaaggcggccgtgcgacaaccagatcgcgcgcatcatccgacaggcccaggtacacgtcgacgagtttccgacgcacgcggaatcgcgcctcaccgcgcactaccgctcgcgggcggccgggaacaatcgtccggcgtggacccgaccggcgtggacccgctactacaagatccacacagacgtcgaatatctcatatgcaaagcccttacctttgacgcggcgctccgcccaagcgccgcggagttgctgcgcctgccgctatttcaccctaagtgaccccgctccccccggggggcgtggaggggggggctggttggatgtttttgcacaaaaagacgcggccctcgggctttggtgtttttggcaccttgccgcccggcgtcatgcacgccatcgctcccaggttgcttcttctttttgttctttctggtcttccggggacacgcggcgggtcgggtgtccccggaccaattaatccccccaacagcgatgttgttttcccgggaggttcccccgtggctcaatattgttatgcctatccccggttggacgatcccgggcccttgggttccgcggacgccgggcggcaagacctgccccggcgcgtcgtccgtcacgagcccctgggccgctcgttcctcacgggggggctggttttgctggcgccgccggtacgcggatttggcgcacccaacgcaacgtatgcggcccgtgtgacgtactaccggctcacccgcgcctgccgtcagcccatcctccttcggcagtatggagggtgtcgcggcggcgagccgccgtccccaaagacgtgcgggtcgtacacgtacacgtaccagggcggcgggcctccgacccggtacgctctcgtaaatgcttccctgctggtgccgatctgggaccgcgccgcggagacattcgagtaccagatcgaactcggcggcgagctgcacgtgggtctgttgtgggtagaggtgggcggggagggccccggccccaccgcccccccacaggcggcgcgtgcggagggcggcccgtgcgtccccccggtccccgcgggccgcccgtggcgctcggtgcccccggtatggtattccgcccccaaccccgggtttcgtggcctgcgtttccgggagcgctgtctgcccccacagacgcccgccgcccccagcgacctaccacgcgtcgcttttgctccccagagcctgctggtggggattacgggccgcacgtttattcggatggcacgacccacggaagacgtcggggtcctgccgccccattgggcccccggggccctagatgacggtccgtacgcccccttcccaccccgcccgcggtttcgacgcgccctgcggacagaccccgagggggtcgaccccgacgttcgggccccccgaaccgggcggcgcctcatggccttgaccgaggacacgtcctccgattcgcctacgtccgctccggagaagacgcccctccctgtgtcggccaccgccatggcaccctcagtcgacccaagcgcggaaccgaccgcccccgcaaccactactccccccgacgagatggccacacaagccgcaacggtcgccgttacgccggaggaaacggcagtcgcctccccgcccgcgactgcatccgtggagtcgtcgccactccccgccgcggcggcggcaacgcccggggccgggcacacgaacaccagcagcgcctccgcagcgaaaacgccccccaccacaccagcccccacgacccccccgcccacgtctacccacgcgaccccccgccccacgactccggggccccaaacaacccctcccggacccgcaaccccgggtccggtgggcgcctccgccgcgcccacggccgattcccccctcaccgcctcgccccccgctaccgcgccggggccctcggccgccaacgtttcggtcgccgcgaccaccgccacgcccggaacccggggcaccgcccgtacccccccaacggacccaaagacgcacccacacggacccgcggacgctccccccggctcgccagcccccccaccccccgaacatcgcggcggacccgaggagtttgagggcgccggggacggcgaaccccccgaggacgacgacagcgccaccggcctcgccttccgaactccgaaccccaacaaaccaccccccgcgcgccccgggcccatccgccccacgctcccgccaggaattcttgggccgctcgcccccaacacgcctcgcccccccgcccaagctcccgctaaggacatgccctcgggccccacaccccaacacatccccctgttctggttcctaacggcctcccctgctctagatatcctctttatcatcagcaccaccatccacacggcggcgttcgtttgtctggtcgccttggcagcacaactttggcgcggccgggcggggcgcaggcgatacgcgcacccgagcgtgcgttacgtatgtctgccacccgagcgggattagggggtgggggtggggggcgagaaacgatgaaggacgggaaagggaacagcgaccaaatgtcacgataagaacaataaacctgtgacgtcaatcagatatgtgagtttggttgtgttttgtgggactgggggcggggggtgggaggtatcagtgggtgacagagtcttttaaaagacgtgtcccggggccctcgagacgcgcaacttttggccacacagagaaaggcccccagacgaagtcacccgggtccccgaacaaaaacaaaaaccttgaccgccgccggggggcgtgcctgttgttttggtctcaatggatcggtatgccgttcggacctgggggattgtgggaatcctcgggtgtgctgctgttggggccgcacccaccggccccgcgtccgatacaacaaacgcgaccgcacgcctccccacgcaccccccactcatccgttccgggggctttgccgtccccctcatcgtgggggggctgtgtctcatgattctggggatggcgtgtctactcgaggtcctgcgtcgcctgggtcgcgagttggcgaggtgctgcccccacgcgggccaatttgccccatgatttttcgcctttctggccttgcccccaccccatcgccccgattgtgtgtcgggtgcccggggtacagcagctatggagcggtcggtaatataactttggttgtcgccacacgccccgtgccgggcatgggttgtgcgggaaggacgaaataatccggcgatccccaagcgtaccaactgggggggggggggggaaaagaaactaaaaacacatcaagcccacaacccatcccacaatgggggttatggcggacccaccgcaccaccatactccgattcgaccacatatgcaaccaaatcacccccagaggggaggttccatttttacgaggaggaggagtataatagagtctttgtgtttaaaacccggggtcggtgtggtgttcggtcataagctgcattgcgaacgactagtcgccgtttttcgtgtgcatcgcgtatcacggcatggggcgtttgacctccggcgtcgggacggcggccctgctagttgtcgcggtgggactccgcgtcgtctgcgccaaatacgccttagcagacccctcgcttaagatggccgatcccaatcgatttcgcgggaagaaccttccggttttggaccagctgaccgacccccccggggtgaagcgtgtttaccacattcagccgagcctggaggacccgttccagccccccagcatcccgatcactgtgtactacgcagtgctggaacgtgcctgccgcagcgtgctcctacatgccccatcggaggccccccagatcgtgcgcggggcttcggacgaggcccgaaagcacacgtacaacctgaccatcgcctggtatcgcatgggagacaattgcgctatccccatcacggttatggaatacaccgagtgcccctacaacaagtcgttgggggtctgccccatccgaacgcagccccgctggagctactatgacagctttagcgccgtcagcgaggataacctgggattcctgatgcacgcccccgccttcgagaccgcgggtacgtacctgcggctagtgaagataaacgactggacggagatcacacaatttatcctggagcaccgggcccgcgcctcctgcaagtacgctctccccctgcgcatccccccggcagcgtgcctcacctcgaaggcctaccaacagggcgtgacggtcgacagcatcgggatgctaccccgctttatccccgaaaaccagcgcaccgtcgccctatacagcttaaaaatcgccgggtggcacggccccaagcccccgtacaccagcaccctgctgccgccggagctgtccgacaccaccaacgccacgcaacccgaactcgttccggaagaccccgaggactcggccctcttagaggatcccgccgggacggtgtcttcgcagatccccccaaactggcacatcccgtcgatccaggacgtcgcgccgcaccacgcccccgccgcccccagcaacccgggcctgatcatcggcgcgctggccggcagtaccctggcggtgctggtcatcggcggtattgcgttttgggtacgccgccgcgctcagatggcccccaagcgcctacgtctcccccacatccgggatgacgacgcgcccccctcgcaccagccattgttttactagaggagtttccccgctcccgtgtacctctgggcccgtgtgggagggtggctggggtatttgggtgggacttggactccgcataaagggagtctcgaaggagggaaactaggacagttcataggccgggagcgtggggcgcgcaccgctgtcccgacgattagccaccgcgcccacagccacctcgacccgtccgatcccggtatgcccggccgctcgctgcagggcctggcgatcctgggcctgtgggtctgcgccaccggcctggtcgtccgcggccccacggtcagtctggtctcagactcactcgtggatgccggggccgtggggccccagggcttcgtggaagaggacctgcgtgttttcggggagcttcattttgtgggggcccaggtcccccacacaaactactacgacggcatcatcgagctgtttcactaccccctggggaaccactgcccccgcgttgtacacgtggtcacactgaccgcatgcccccgccgccccgccgtggcgttcaccttgtgtcgctcgacgcaccacgcccacagccccgcctatccgaccctggagctgggtctggcgcggcagccgcttctgcgggttcgaacggcaacgcgcgactatgccggtctgtatgtcctgcgcgtatgggtcggcagcgcgacgaacgccagccggtttgttttgggggtggcgctctctgccaacgggacgtttgtgtataacggctcggactacggctcctgcgatccggcgcagcttcccttttcggccccgcgcctgggaccctcgagcgtatacacccccggagcctcccgacccacccctccacggacaacgacacccccgtcctccccccgagacccgacccccgcccccggggacacagggacgcccgcgcccgcgagcggcgagatagccccgcccaattccacgcgatcggccagcgaatcgagacacaggctaaccgtagcccaggtaatccagatcgccataccggcgtccatcatcgcctttgtgtttctgggcagctgtatctgcttcatccatagatgccagcgccgatacaggcgcccccgcggccagatttacaaccccgggggcgtttcctgcgcggtcaacgaggcggccatggcccgcctcggagccgagctgcgatcccacccaaacaccccccccaaaccccgacgccgttcgtcgtcgtccacgaccatgccttccctaacgtcgatagctgaggaatcggagccaggtccagtcgtgctgctgtccgtcagtcctcggccccgcagtggcccgacggccccccaagaggtctaggtccaagcgggccgttcggcaggcccgccccaccgcccccatcgtggttatttccccccccccccaataaaccgatgttatttgcctatatgcgtgtgttggatccctttgtgatcgttcgtcattccccggatggcatgggaggcgggtaatggatgggcggggcccgggggggaggaaaaagaataaagggggtagtgtcggagaggcccgccgcgcatttaaggagtcgccgccccgactctgtgtcttcgggtgacttggtgcgccgccgtcagctagtctccgatctgccccgaccgacggctcctgccacccgaacatggctcgcggggccgggttggtgttttttgttggagtttgggtcgtatcgtgcctggcggcagcacccagaacgtcctggaaacgggtaacctcgggcgaggacgtggtgttgcttccggcgcccgcggaacgcacccgggcccacaaactactgtgggccgcggaacccctggatgcctgcggtcccctgcgcccgtcgtgggtggcgctgtggcccccccgacgggtgctcgagacggtcgtggatgcggcgtgcatgcgcgccccggaaccgctcgccatagcatacagtcccccgttccccgcgggcgacgagggactgtattcggagttggcgtggcgcgatcgcgtagccgtggtcaacgagagtctggtcatctacggggccctggagacggacagcggtctgtacaccctgtccgtggtcggcctaagcgacgaggcgcgccaagtggcgtcggtggttctggtcgtggagcccgcccctgtgccgaccccgacccccgacgactacgacgaagaagacgacgcgggcgtgagcgaacgcacgccggtcagcgttccccccccaacccccccccgtcgtccccccgtcgcccccccgacgcaccctcgtgttatccccgaggtgtcccacgtgcgcggggtaacggtccatatggagaccccggaggccattctgtttgcccccggggagacgtttgggacgaacgtctccatccacgccattgcccacgacgacggtccgtacgccatggacgtcgtctggatgcggtttgacgtgccgtcctcgtgcgccgagatgcggatctacgaagcttgtctgtatcacccgcagcttccagagtgtctatctccggccgacgcgccgtgcgccgtaagttcctgggcgtaccgcctggcggtccgcagctacgccggctgttccaggactacgcccccgccgcgatgttttgccgaggctcgcatggaaccggtcccggggttggcgtggctggcctccaccgtcaatctggaattccagcacgcctccccccagcacgccggcctctacctgtgcgtggtgtacgtggacgatcatatccacgcctggggccacatgaccatcagcaccgcggcgcagtaccggaacgcggtggtggaacagcacctcccccagcgccagcccgagcccgtcgagcccacccgcccgcacgtgagagccccccatcccgcgccctccgcgcgcggcccgctgcgcctcggggcggtgctgggggcggccctgttgctggccgccctcgggctgtccgcgtgggcgtgcatgacctgctggcgcaggcgctcctggcgggcggttaaaagccgggcctcggcgacgggccccacttacattcgcgtggcggacagcgagctgtacgcggactggagttcggacagcgagggggagcgcgacgggtccctgtggcaggaccctccggagagacccgactctccctccacaaatggatccggctttgagatcttatcaccaacggctccgtctgtatacccccatagcgaggggcgtaaatctcgccgcccgctcaccacctttggttcgggaagcccgggccgtcgtcactcccaggcctcctatccgtccgtcctctggtaaggcgtcttccgacgacgcggacgtcggcgatgaactgattgccatcgcggacgcacgcggggacccgccagagaccctgccccccggcgcgggcggcgccgcgcccgcgtgccgcagaccacctcgcggcggctcccccgcggcctttcccgtggccctccacgccgtggacgccccctcccaattcgtcacctggctcgccgtgcgctggctgcggggggcggtgggtctcggggccgtcctgtgcgggattgcgttttacgtgacgtcaatcgcccgaggcgcataaaggtccggcggccagccccgccgcagctcataaaaatcgtgagtcacggcaaccgcaccttcgcctccggccctccgccagcgcccttccgcgtccgcgatgacctcccggcccgccgaccaagactcggtgcgttccagcgcgtcggtgccgctttaccccgcggcctcgcccgtcccggcagaagcctactactcggaaagcgaagacgaggccgccaacgacttcctcgtgcgcatgggccgccagcagtcggtcctaaggcgccgacggcggcgcacgcggtgcgtcgggctggttatcgcctgtctcgtcgtggccctcctatctggagggttcggggcacttttggtgtggctgctccgctaaatgacgcctcgatgtatggcgccttcttcgcccccacccctcgccgcgacccacgtccgtatgttaattgcaataaagtggttgattgtcattacggtctactaggttgtcttttttttttgggggggggggaggaaatgcagaaaagggtaagaaattctcggaatttcacccccgggggggggcaagtgcagtaacccagttcctcagtgtttgggaaatctattgaactctcccggctcctccgtgttagggaagtctcttggggaaatctattgacctctcgccccccccccccaggaggggggcagtgcagtaccccagttcctccgtgctggggaaatctctctgccgggtacgggctccagacgaaggacccatacatttccccatccgcaccccacatctggcgttctagagtcacgacgcatttgcccccgtccccgcagcaacacacaaagcgatttcaattttcacgattttattattaattacaccaaccaccctgtccccgggacgtggtcaggaccgggggtccgcacccaaacgcacgaaacaaatgctggcagtgtgccgaatataaccccgcgtaggaacacgtcgacgcgtgcgccaaacagcaccagaaggcgcatgccatcagcaggtcgtgcatatggcgatgtgtttggacgcagggcgcagccgcggcgataaaattcatggcggccgtccgccagggccacagcggcgaggactccctgttggcccgaagccattgggtatgaaccagctgcgcctcctgtccgaccctggctcccgccagcgggggcggtgggtcgtgggtgttgagagcacacaggcgggacacctcgatcaccgtccgaaaaaaggcccggtggtccgcgggcagcatctgcaggtgcgccagggcctgggcgttgagagggtacaactcggagccgggggactccgggggccggtccgcgcggtgccgcgagttggcacgctttggggcccgggtgtcggacgcgggcgcgttatggatcccgacgcggggcagaacgtacgtgcgttggcgcggcgatgaggggtccgggctgccgaggggggcgtaggggaccgggctaggcaagcccgcgggttgcgcggggttcccgtgggggtctaggctccctgggcacccgtgggggtcgtgggggtcgcgggtccctgggtatgcgcgggaccctgggttctctgggagatcgtggaactcgcggttccctgggctctcggggaacccggggctccctggggacacgtggtgccctgggaattcttgatggtcggacggcttcagatggcttcgggatcgagagggccgcacagactcgtagtagacccgaatctccacgtttccccgccgccggatcatggtcgccgccccggtgcgggggcccgtcggtcggaagcgagtgcccttcaagcgtgtccgctcctctgggctgcatgccgtcggatggggtgccttttaaggaaaggtctcggctgcccgccccaaccggggtttgggggtgggccggggaaaccccggatgccatgggggggtcacaccctaagcgccggcgcgctggttgggtgggggtagaggggagtccccggtcgacgagatcgtataagctgggtaccgagctcgaattcatcgatgatatcagatcgatccccatggtgtcccgtccacgaaggcggcgcccggcctgcgagaaagcgcggatgttgggatcggggccccgtccccccgttccccggcccgtccccccgtccccccggcccgtccccccggcccgtccccccggcccggccccccgggtcaccgtacctgcgataaggctgcagtgggtggatgggtcctcgcggtacgtacagggtgggggggggggggggagggaaaggcagaacgaaaaggaaccgatgcgcccgcgtctctgtatccgatccgatccgggtgcgtcggtgccccgctcgccgccggcgtctctgtctcgctgtggcccccttcgcgatgccgccgctgccgtcccggtctccgccgcgcagccggtgtgcccctggtgcggcggcgaccgggacgccggccctttatgtgcgcgaggaacggcccgccccccgtccgggcccgcctcggggcggagcccgcgggatgacgcgggccccgggcagggcgccagtgctcgcactttgccctaataatatatatactattaggacgaagtgcgaacgcttcgcgttctcacttcttttaccctgcggccccgccccctttggggcggagcccgcgggatgacgcgggccccgggcagggcgccagcgctcgcactttgccctaataatatatatactattaggacgaagtgcgaacgcttcgcgttctcacttcttttaccctgcggccccgccccctttggggcggagccgcccgcggaccaacggggcgacctcgccggcccctttggggccggcgggggccaacgggagcgcggggccggcatctcattaccacgaacccggaagggcaggggagcgagcccgcccgcgacgagggtctcattagcatcgcgggcggaagcggaagccgcccgcgccgggcgctaatgagatgccgcgcgggcggagccggcggcggcgcgaccaacgggccgccgccacggacgcggacgcgcgggcgtcggggcggggccgcgcataatgcggttccacctgggggcggaaccccggcgagccggggcgcggcggcgtcgatcgctcctcctccgcgtcctcctcctttccccccgccccgcgcgccccgaggactatatcagccaggcgacggggcgatcgtccacacggagcgcggctaccgacgcggccgccaggatctacccgatcggcgcggagaggcgaaaagacacaggcacacgcacgcaccgcacgggggggagagagactgccaaccacccccccccactgccgcccctgaagaagaagaagaagacccccccccgcacaccccggtcggaggcgatgtcggcggagcagcggaagaagaagaagacgacgacgacgacgcagggccgcggggccgaggtcgcgatggcggacgaggacgggggacgtctccgggccgcggcggagacgaccggcggccccggatctccggatccagccgacggaccgccgcccaccccgaacccggaccgtcgccccgccgcgcggcccgggttcgggtggcacggtgggccggaggagaacgaagacgaggccgacgacgccgccgccgatgccgatgccgacgaggcggccccggcgtccggggaggccgtcgacgagcctgccgcggacggcgtcgtctcgccgcggcagctggccctgctggcctcgatggtggacgaggccgttcgcacgatcccgtcgccccccccggagcgcgacggcgcggaagaagaagcggcccgctcgccttctccgccgcggaccccctccatgcgcgccgattatggcgaggagaacgacgacgacgacgacgacgacgatgacgacgaccgcgacgcgggccgctgggtccgcggaccggagacgacgtccgcggtccgcggggcgtacccggaccccatggccagcctgtcgccgcgacccccggcgccccgccgacaccaccaccaccaccaccaccgccgccggcgcgccccccgccggcgctcggccgcctctgactcatcaaaatccggatcctcgtcgtcggcgtcctccgcctcctcctccgcctcctcctcctcgtctgcatccgcctcctcgtctgacgacgacgacgacgacgacgccgcccgcgcccccgccagcgccgcagaccacgccgcgggcgggaccctcggcgcggacgacgaggaggcgggggtgcccgcgagggccccgggggcggcgccccggccgagcccgcccagggccgagcccgccccggcccggacccccgcggcgaccgcgggccgcctggagcgccgccgggcccgcgcggcggtggccggccgcgacgccacgggccgcttcacggccgggcggccccggcgggtcgagctggacgccgacgcggcctccggcgccttctacgcgcgctaccgcgacgggtacgtcagcggggagccgtggcccggggccggccccccgcccccggggcgcgtgctgtacggcgggctgggcgacagccgccccggcctctggggggcgcccgaggcggaggaggcgcgggcccggttcgaggcctcgggcgccccggcgcccgtgtgggcgcccgagctgggcgacgcggcgcagcagtacgccctgatcacgcggctgctgtacacgccggacgcggaggcgatggggtggctccagaacccgcgcgtggcgcccggggacgtggcgctggaccaggcctgcttccggatctcgggcgcggcgcgcaacagcagctccttcatctccggcagcgtggcgcgggccgtgccccacctggggtacgccatggcggcgggccgcttcggctggggcctggcgcacgtggcggccgccgtggccatgagccgccgctacgaccgcgcgcagaagggcttcctgctgaccagcctgcgccgcgcctacgcgcccctgctggcgcgcgagaacgcggcgctgaccggggcgcgaacccccgacgacggcggcgacgccaaccgccacgacggcgacgacgcccgcgggaagcccgccgccgccgccgccccgttgccgtcggcggcggcgtcgccggccgacgagcgcgcggtgcccgccggctacggcgccgcgggggtgctcgccgccctggggcgcctgagcgccgcgcccgcctccgcgccggccggggccgacgacgacgacgacgacgacggcgccggcggtggtggcggcggccggcgcgcggaggcgggccgcgtggccgtggagtgcctggccgcctgccgcgggatcctggaggcgctggcggagggcttcgacggcgacctggcggccgtgccggggctggccggagcccggcccgccgcgcccccgcgcccggggcccgcgggcgcggccgccccgccgcacgccgacgcgccccgcctgcgcgcctggctgcgcgagctgcggttcgtgcgcgacgcgctggtgctgatgcgcctgcgcggggacctgcgcgtggccggcggcagcgaggccgccgtggccgccgtgcgcgccgtgagcctggtcgccggggccctgggcccggcgctgccgcggagcccgcgcctgctgagctccgccgccgccgccgccgcggacctgctcttccagaaccagagcctgcgccccctgctggccgacaccgtcgccgcggccgactcgctcgccgcgcccgcctccgcgccgcgggaggcgcgcaagcgcaagagccccgccccggccagggcgccgccgggcggcgccccgcgccccccgaagaagagccgcgcggacgccccccgccccgcggccgcccctcccgcgggggccgcgccccccgccccgccgacgccgccgccgcggccgccgcgccccgcggcgctgacccgccggcccgccgagggccccgacccgcagggcggctggcgccgccagccgccggggcccagccacacgccggcgccctcggccgccgccctggaggcctactgcgccccgcgggccgtggccgagctcacggaccacccgctcttccccgcgccgtggcgcccggccctcatgttcgacccgcgcgcgctggcctcgctggccgcgcgctgcgccgccccgccccccggcggcgcgcccgccgccttcggcccgctgcgcgcctcgggcccgctgcgccgcgcggcggcctggatgcgccaggtgcccgacccggaggacgtgcgcgtggtgatcctctactcgccgctgccgggcgaggacctggccgcgggccgcgccgggggcgggccccccccggagtggtccgccgagcgcggcgggctgtcctgcctgctggcggccctgggcaaccggctctgcgggcccgccacggccgcctgggcgggcaactggaccggcgcccccgacgtctcggcgctgggcgcgcagggcgtgctgctgctgtccacgcgggacctggccttcgccggcgccgtggagttcctggggctgctggccggcgcctgcgaccgccgcctcatcgtcgtcaacgccgtgcgcgccgcggactggcccgccgacgggcccgtggtctcgcggcagcacgcctacctggcctgcgaggtgctgcccgccgtgcagtgcgccgtgcgctggccggcggcgcgggacctgcgccgcaccgtgctggcctccggccgcgtgttcgggccgggggtcttcgcgcgcgtggaggccgcgcacgcgcgcctgtaccccgacgcgccgccgctgcgcctctgccgcggggccaacgtgcggtaccgcgtgcgcacgcgcttcggccccgacacgctggtgcccatgtccccgcgcgagtaccgccgcgccgtgctcccggcgctggacggccgggccgccgcctcgggcgcgggcgacgccatggcgcccggcgcgccggacttctgcgaggacgaggcgcactcgcaccgcgcctgcgcgcgctggggcctgggcgcgccgctgcggcccgtctacgtggcgctggggcgcgacgccgtgcgcggcggcccggcggagctgcgcgggccgcggcgggagttctgcgcgcgggcgctgctcgagcccgacggcgacgcgcccccgctggtgctgcgcgacgacgcggacgcgggcccgcccccgcagatacgctgggcgtcggccgcgggccgcgcggggacggtgctggccgcggcgggcggcggcgtggaggtggtggggaccgccgcggggctggccacgccgccgaggcgcgagcccgtggacatggacgcggagctggaggacgacgacgacggactgtttggggagtgacgggggggaaacttccgggagcgggggaggggggagatggggagagggggaaggaatcgggcgtctgtgcgcctttaagacagacgcggcgatggccgcgcgcgtgtgtgagaaataaagaacgagacagacgaaaacgtaccgccttgtgtggtttattcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggtgggcggcacgtctcccgcgcccgcggggggtctggggctctgacctgagtgcaggttacgaaggtcaggtggcccgagcccccccgcaggagcgggagggaaggcacggggcgcgggagggaggggctgctgcgagctcggggccgcgggcgcggggggaggggcgggggaagcccccggggcggggcgcgggggaggcggccgcgggggaggcggccgcgggaccgcagccccgtggcgcgcgggggggaggggctgccgcgagctcggcgggatggaggggagggagggggtggcggggaaccgtgtgcgggcgggcgggtgcttggtgcaactgtctggtctgcgagggcgagcggtggtgcgactggcgtcttcgggggggcggggagcttgggagtgtgtggtggtctgcggcacagcctgctagtccccgtcttgccgcgcgggggcgggcgcgggaaaaaagccgcgcgggggcgcccgcgggaaggcagccccgcggcgcgcggggggaggggcggcgcccgcgggggagcggccggctccgggggagggacggggaagggggcgcgcggggctgccctgccgcccgcccgccgccgccgcccgccttcgcgcccccccccaaaaaacaccccccccgggggttgactccccgggggaaaagaggcggggcggg

SEQ ID NO: 18 - DNA, 157397 bp, synthetic construct
  source 1..157397: mol_type = other DNA
agtccccgtcttgccgcgcgggggcgggcgcgggaaaaaagccgcgcgggggcgcccgcgggaaggcagccccgcggcgcgcggggggaggggcggcgcccgcgggggagcggccggctccgggggagggacggggaagggggcgcgcggggctgccctgccgcccgcccgccgccgccgcccgccttcgcgcccccccccaaaaaacaccccccccgggggttgactccccgggggaaaagaggcggggcgggagtccccgtcctgccgccgccccttaagagggcccgcaacacggcccgggctgcgcacgccagccgggacgggtgagttcgctaggcaagcacggactggcggttacacggataacctggttctttccgcctcagaagccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagcatttaggtgacactatagaatagggccctctagctcgagtcagctggcgttcaggtagctcatcacccggtcgatggtcacggcccggatccggaaggcgtgcagcaggatgcacagcttgatcttggtcttgtagaagtcgggctcctccaggctgctcttctggggcacggtctcgctgttgaagttcagggcctgcatcagctcgtcgatcacggccagcatgttctggtccaggaagatctgccgcttggggtccatcagcagcttggcgttcatggtcttgaactccacctggtacatcttcaggtcctcgtagatgctgctcaggcacagggccatcatgaagctggtcttccggctggccaggcagctgccgttggtgatgaagctggtctcccggctgttcaggcagctctcgttcttggtcagctccaggggcaggcaggcctccacggtgctggtcttgtccttggtgatgtcctcgtggtcgatctcctcgctggtgcaggggtagaactccagggtctgccgggccttctgcagcatgttgctcacggcccgcagcaggttctggctgtggtgcaggcaggggaacatgccggggtcgggggtggccacgggcaggttccgggccaggctcaggtggtccagcagcaccagggtggccaccagcagcaggctccgggcggggcacatgctcagccggcactgcaggctcacgggccgggcggcggggtgcaggccggtggcggcggcggggctgggggggggctggctggcgctgccggggggccacatgcccacgccgggcacgcccacgccgggcacgctgcagggcacgctggcccactcgctccagctgctgctgtagtaccggtcctgggcccgcacgctgatgctggcgttcttccggcagatcacggtggcgctggtcttgtcggtgaacacccggtccttcttctcccgcttgctcttgccctgcacctgcacgcagaaggtcaggctgaagtagctgtggggggtgctccaggtgtcggggtactcccagctcacctccacctgccggctgttcttcaggggcttcagctgcaggttcttgggggggtcgggcttgatgatgtcccggatgaagaagctgctggtgtagttctcgtacttcagcttgtgcacggcgtccaccatcacctcgatgggcaggctctcctcggcggcggggcaggcgctgtcctcctggcactccacgctgtactcgtactccttgttgtcgccccgcacccgctcggcgctcagggtggcggcgccgcaggtcacgccctgggggtcgctgctgccccggctgctcttcacgctgaaggtcaggtcggtgctgatggtggtcagccaccagcaggtgaaccggccgctgtagttcttggcctcgcaccgcaggaaggtcttgttcttgggctccttctggtccttcaggatgtcggtgctccagatgccgtcctccttcttgtgcagcagcagcaggctgtggctcagcacctcgccgcccttgtggcaggtgtactggccggcgtcgccgaactccttcacctggatggtcagggtcttgccgctgcccagcacctcgctgctctggtccagggtccaggtgatgccgtcctcctcgggggtgtcgcaggtcagcaccaccatctcgccgggggcgtcggggtaccagtccagctccaccacgtacacgtccttcttcagctcccagatggccaccagggggctggccaggaacaccaggctgaaccagctgatcaccagctgctggtggcacatggatccagcttgggtctccctatagtgagtcgtattaatttcgataagccagtaagcagtgggttctctagttagccagagagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacgcgtatatctggcccgtacatcgatcatcgatgaattcgagctcggtacccggggatcctctagaccggcttcccggtatggtaattagaaacttttaataggcggtcccggccgccatccccgcgcatggtaattagcaacttttaatgggccggcgttcccgctcgcggtaattagcagcttttaacgggccgccattcccgcttatggtaattaaaaacgttcggacggcccctcgctccccgcgtaattactccctcggggttccgggttatgctgattactttcttggcagaacacgcagagcctcgcgcgccgccgggtgggtgggctgatcggcccctattggtcccctgggcttcctagtatgctaatgaatttctccccgggggcgggcaccactcagggccgcgccggcggggcgccggggggactcccatctgcgtcggcggggggcggcgcatgctaatggggttcttggagtacacccggttggtccccggggacggggccgccccgagagggggggattccctccctccgcccccgccggggcgcgcggctattgggggaatcgtaaatgccgcccctttgggggagtggataggcgccgggtataaggcagccccgtgtgacggtcgggccgcattcgcaccccggcactgcgagcgacggagcggcggcccggcgggaggaggagacccggagagacagagactaaaacccggcaagagagagaccgcgggccgccgtctcgagtctaccctaccccggctcatggaaccccggcccggcacgagctcccgggcggaccccggccccgagcggccgccgcggcagacccccggcacggtgagagggcgacccccgggtctcaggcccccccttttccccggaccacccggctgcgggttgggggtggtcgcgggcggtgggctcgggggcggggacgcttgacggggccgacccccggcccgcttaagcggtcgggggacccccgtgggccgtgcgccgccccccgaccctctgggggggcgagggaggcagggaggagcccgagagcgggggacagggggggagacgaggggtcggaatccaaaggacgcagaccacctttggttacggacccctttctcccccccttccgaacaaaaagcagcgggcggggggccggggtgagggagggacacgggggacacggcgcgggggtcccgcctcacgccccgcgccctctaaatcccccccgttgctttgtcaagcagcccgccgccccgcacgcctgggggatgctcaacgacatgcagtggctcgccagcagcgactcggaggaggagaccgaggtgggaatctctgacgacgaccttcaccgcgactccacctccgaggcgggcagcacggacacggagatgttcgaggcgggcctgatggacgcggccacgcccccggcccggcccccggccgagcgccagggcagccccacgcccgccgacgcgcagggatcctgcgggggtgggcccgtgggtgaggaggaagcggaagcgggaggggggggcgacgtgtgcgccgtgtgcacggacgagatcgccccgcccctgcgctgccagagttttccctgcctgcaccccttctgcatcccgtgcatgaagacctggattccgttgcgcaacacgtgtcccctgtgcaacaccccggtggcgtacctgatagtgggcgtgaccgccagcgggtcgttcagcaccatcccgatagtgaacgacccccggacccgcgtggaggccgaggcggccgtgcgggccggcacggccgtggactttatctggacgggcaaccagcggacggccccgcgctccctgtcgctggggggacacacggtccgcgccctgtcgcccacccccccgtggcccggcacggacgacgaggacgatgacctggccgacggtgagggcgggcgggggtcgggcgggggtcgggcgggggtcgggcgggggtcgggcgggggtcgggcgggggtcgggcgggggtcgggcgggggtcgggcgggggtcgggcgggggtcgggcgggggtcgggcgggggtcgggcactaaccgggggctcccgtctctgtctccctctgcagtggactacgtcccgcccgccccccgaagagcgccccggcgcgggggcggcggtgcgggggcgacccgcggaacctcccagcccgccgcgacccgaccggcgccccctggcgccccgcggagcagcagcagcggcggcgccccgttgcgggcgggggtgggatctgggtctgggggcggccctgccgtcgcggccgtcgtgccgagagtggcctctcttccccctgcggccggcggggggcgcgcgcaggcgcggcgggtgggcgaagacgccgcggcggcggagggcaggacgccccccgcgggacagccccgcgcggcccaggagccccccatagtcatcagcgactctcccccgccgtctccgcgccgccccgcgggccccgggccgctctcctttttctcctcctcctccgcgcaggtgtcctcgggccccggggggggaggtctgccacagtcgtcggggcgcgcggcgcgcccccgcgcggccgtcgccccgcgcgtccggagtccgccccgcgccgccgccgcccccgtggtgtctgcgagcgcggacgcggccgggcccgcgccgcccgccgtgccggtggacgcgcaccgcgcgccccggtcgcgcatgacccaggctcagaccgacacccaagcacagagtctgggccgggcaggcgcgaccgacgcgcgcgggtcgggagggccgggcgcggagggaggacccggggtcccccgcggcaccaacacccccggtgccgccccccacgccgcggagggggcggcggcccgcccccggaagaggcgcgggtcggactcgggccctgcggcctcgtcctccgcctcttcctccgccgccccgcgctcgcccctcgccccccagggggtgggggccaagagggcggcgccgcgccgggccccggactcggactcgggcgaccgcggccacgggccgctcgccccggcgtccgcgggcgccgcgcccccgtcggcgtctccgtcgtcccaggccgcggtcgccgccgccgcctcctcttcctcctccgccgcctcctcttcctcctccgccgcctcctcttcctcctccgccgcctcctcttcctcctccgccgcctcttcctcctccgccgcctcctcttcctcctcctcctcctccgcctcttcctctgcgggcggggctggtgggagcgtcgcgtccgcgtccggcgctggggagagacgagaaacctccctcggcccccgcgctgctgcgccgcgggggccgaggaagtgtgccaggaagacgcgccacgcggagggcggccccgagcccggggcccgcgacccggcgcccggcctcacgcgctacctgcccatcgcgggggtctcgagcgtcgtggccctggcgccttacgtgaacaagacggtcacgggggactgcctgcccgtcctggacatggagacgggccacataggggcctacgtggtcctcgtggaccagacggggaacgtggcggacctgctgcgggccgcggcccccgcgtggagccgccgcaccctgctccccgagcacgcgcgcaactgcgtgaggccccccgactacccgacgccccccgcgtcggagtggaacagcctctggatgaccccggtgggcaacatgctctttgaccagggcaccctggtgggcgcgctggacttccacggcctccggtcgcgccacccgtggtctcgggagcagggcgcgcccgcgccggccggcgacgcccccgcgggccacggggagtagggggagctaacactcggcttgctgcccaaagggaagccgccccccaccggaccaccggccgaggcgcctcgggggcagggggaggtgggggggaaagacggggaggagacaggaagtgggggtgggagtggggggggacggacacggccccgaacagcaacacacaccagcattttgttatggactttctggccttgttgaaaacttgaggaaaaaaaactttatatttataaaaattttacaataaagttttgtgatgcttttgacacactttgttgttggcctttgatgcagctcccccgcgcaggggggccggggatggggggggggaaagggaggaggaggagggggggcgggcacgagaagccgcccccacccccgaggcctgttggtctttatgatagaacagagccggggcccggcctgcgttctggctccctgtcttggtgggtgggcgggctggctggcgggtaaaaaaagagtgtgtccgtgttgacagggaggggggcccgatcgtgcagagcacgcacgtctggccggccagaccctgggggtggtgggcaggagtgggagggcgcctggctcggggagggaggagggggggggtcagccgcaccaccggcgcgaagccaggggccagggaactttgatagagagggggggaaagtggggcgggggcgagggcggttgaatcacaacgcatgcacgccctctgcccccggggacgggtgggaggaaggaggagggagaagagaagacccgaggcatgcacccgcacttacgcccgtgcccacccccgccccggcgcccaccccgcccgcacacctgcccgccacgcccgcccctcctcaccctggctgggagaaaggaggaggagcaggaagaggagacccgaggcatgcaaccgcactcaccccaccccgcccgcacacctgcccgccacgcccgcccctccttaccctggctgcggggagactcccatcggggcgagggggctcgcgcgttcgcaacaccacaccacaccacacggcccaccacaacacggcccaccacgacacaacacgacacgacgcgttttgcggggcatgcaagtcgacacaccgcgcgcgtgcctacctttccctagcggccccggcccccggcccgtttccttccgccaccactaccaccacccccccgcccgcgcccacgcggtagaggaaggggacgggcgccacacccacggctgtggctgggcacgcgcctttggggttgttgggggggggtgaccggcgcgtgggggcggtgggcgtatgggcccgacccgcgcctgccccccctgggaacgacgcccccggacgacaccacgggggggggaaacgggggtgggtggaagggaagaggaaggagaaagggggggtggatccgaacacgccggatccgcgaaaataataacaaaacaaacaaaaacagaaacaaaaacaaaaacacctagaaaaaaaggatacgggttggctcgcgggcggtgcggctgacctgcctgccctttctgggacccccgcctcgtgtttcttgaaagggggaggaagaacagttctcccccaacccctgctctcttctctcttccgcccgccccccccccctctcccgccgcctcagcagaagctcacctgtacgaccctaaacctacctgcgagaacgcgcggcgttcgaggggcgcgctctctcacacgagacacacgcaggcgccccccccccccggagcctgggtcccccggcggacggctcacgcggcgcggcgtctcggtgggacgcgggcagagggcggcggcggcgggggggggggggaaatgtgaggagagcgagacagagagagagaaggaagagggaaggggcgcggcgggacgggggaagacgaggagaagggaaggggcgagggtcgggcccgggagcggggcggccgggagggagaagaaacggaacgcggaaacgccgccggcgcggcccggggccccggggcccccgcgctccgccgggggcccgggccggaccgccgggcgggggacgccttccgcccggcgccgggcggctacccgggacccccggccgggaatcgaaaaaagcctccgggggcccctttcgcgcctttcgcgaacgcgcggcgccggagggggcggccgccgaggtgcgggggcccctccggccggggcgcacctcggcggccaagccccggcccgcccgggggtccccgaggcagaggcggaccctcggaggcgcggaagaagacgggaggcgggggaaaaaagggggaagagagggggaggtagggaggggagaggagaagggcgcgccggtgcgcggagcagccttccttctccggagtccctctcgatcggcggcgggcccctgcgttcgttgctgccgcgcccccggttttataaagacagggatgacgcagcagaaatgcccacagcaacacgcgggcggggctcgggctctccggcggcttaatggatctccgggcacggcgcccgcaaccgcagagcactcagctggcgcgcccccccccaacgtgggagtgtttaatggaagggcgtggggccggccgccggatgcccgcgggggcctaatgcggcgggaggcgtgggccgctggcgccgcggcccgtctgctggcccgcggcccgtctgctggcccgcggccacgtaaacaatgacacaggggttctctccgccgcggccggcgcggggcgttgccggcccggcccggccccggagcccgcggcgctgctcggctgcggccgcgggctccgggggctccgcactctgcccggctcgccccgtcccccctcttgctgcttttccgcgcgcctctctttcccgttgctttccctctccccccccccccctctctctctctctctctctctctccgccatcctcccgcccggccgcccactccccgctcggcctctccggctgcggtgcttgggtctccttcgtcgggcggcggggggggggcgtcgggactcgcggagggccggagaatggaaggcgaggggatgcaggaggaggatcgggactccccatcttctgcccttccatcctccgtttttccgctttccaccgccgccgccaccacccccccttccttcgcccgcccgcctcgccccggacccctcccccccgtgttccccccatcgttcaccaccacgccccccaccgcgccttggctgtttggggggtggcggcggtggtcggcgtgctgccggaggctgcgggcgcggggtaggtgggtgggcgggtggtgggggggggcccggctgcgtctcgccgcgatcccgccggtggggcgcggcggcggtcggggtggggggagagtgtcgtgggtgtgttttcgtgtcccccaccaccactcccaccccgaccgccgccgcgcccgcgtttctgccgcccgcgcgctcctgtgtggaccccggggtgggcggcggggggggggtgccgtgggtgtggcggcggggcgcgggccggggccggggctcgctggtccgccgaagtaaagaaaagatcgccaccgtgtgttcgtctgtgtgttctgcgcggcgccggggcccccctgccgggcggggcggtggggcggggccggggtcgcggcggggaaggaaggaaagaccccggaagcgccgggagggggcgccggcgcgacgcgggcggccgggcgggggcgcgcggcggccgggcgggggcgcgcggcggccgggcgggggcgcgcggcggccgggcgggggcgcgcggcggccgggcgggggcgcgcggcggccgggcgggggcgcgcggcggccgggcgggggcgcgctttccccgcgtcgcccctcgggttcccaagacctatcacgtgtgcgcaggggaggggaggacgcgggggaggggaggacgcgggggaggggaggacgcgggggatatataaagcggtagaaagcgcgggaatgggcatattggacccgcgtgattcggttgctcgcggttgtcttgtttggacgttttttatgcgggaacaagggggcttaccggttacactgtccgctcgctatggggttcgtctgtctgtttgggcttgtcgttatgggagcctggggggcgtggggtgggtcacaggcaaccgaatatgttcttcgtagtgttattgccaaagaggtgggggacatactaagagtgccttgcatgcggacccccgcggacgatgtttcttggcgctacgaggccccgtccgttattgactatgcccgcatagacggaatatttcttcgctatcactgcccggggttggacacgtttttgtgggataggcacgcccagagggcgtatctggttaacccctttctctttgcggcgggatttttggaggacttgagtcactctgtgtttccggccgacacccaggaaacaacgacgcgccgggccctttataaagagatacgcgatgcgttgggcagtcgaaaacaggccgtcagccacgcacccgtcagggccgggtgtgtaaactttgactactcacgcactcgccgctgcgtcgggcgacgcgatttacggcctgccaacaccacgtcaacgtgggaaccgcctgtgtcgtcggacgatgaagcgagctcgcagtcgaagcccctcgccacccagccgcccgtcctcgccctttcgaacgcccccccacggcgggtctccccgacgcgaggtcggcgccggcatactcgcctccgacgcaactagccacgtctgcatcgcaagccaccctgggtcgggagcaggacagccgacccgtctagcggccgggtcggctgtccagcgtcgtcgccctagaggctgtccgccgggcgtgatgttttccgcatctacgacccccgaacagcccctggggctgtcgggcgatgcgacgccgcccctgccgacttccgtgcccctggactgggccgcgtttcggcgcgcgtttctgatcgacgacgcctggcggcccctgttggagccggagctcgcgaaccccctaaccgcgcgcctcctcgcggagtatgaccgtcggtgccagaccgaagaggtgctgccgccgcgggaggatgtgttctcctggacgcggtattgtacccccgacgacgtgcgcgtggttatcatcgggcaggacccgtaccaccatcccggccaggcgcacggcctggcgtttagcgtgcgtgcggatgtgccggtgcctccgagtctacggaacgtgctggcggcggttaaaaattgttaccccgacgcgcgcatgagcggccgcggctgcctggaaaagtgggctcgcgacggcgtgctgttgttgaacacgaccctgaccgtcaagcgcggggcggcggcgtcccactccaagcttggatgggaccgttttgtgggcggggtggtccgacggctggccgcgcgccgcccgggcctggtctttatgctctggggcgcccatgcccagaacgcgatcaggcccgaccctcgccaacactacgtcctcaagttttctcacccgtcgcccctctccaaggtcccgtttgggacgtgccagcatttcctcgccgcgaatcgctacctcgaaacccgggacattatgccgatcgactggtcggtataagatgccgacatccggggtcttgatttacgagggggcaattaataaagactgttgatggttaaatctcgggtctcataccggtccgtgatgtcgggcgtgggggaagagagggtcccctctgcgtttactatccttgcctcgtggggctggacgtttgcaccccagaaccatgatcctggcgcgtcgccgaatacgacgcccatagagtcgattgcggggaccgcaccggacgcgcacgtggggcctctcgacggagagccggaccgggatgcgatctccccgcttacgtcgagcgtggccggcgacccgccgggggcggacggcccctacgtcacctttgatactctgtttatggtatcttcgatcgacgaactggggcgccgccagctcacggatacgatccgtaaggacctgcggctgtcgctggccaagttcagcatcgcgtgtaccaagacctcgtcgttttcggggacggccgcgcgccagcgcaagcgcggagcaccgccgcaacgcacatgcgtaccacgcagcaacaagagcctccagatgttcgttttgtgcaagcgcgccaacgccgcgcaggtgcgcgagcagctgcgggcggttattcggtcgcgcaagccgcgcaagtattacacgcggtcctcggatgggcggctctgcccggccgtccccgtgtttgtacacgagtttgtttcgtccgaacccatgcgcctccatcgagataacgtcatgctgtctacggaaccagactaagcacccccgccgtcccctttcttttccccctacccttccccccgttactgatgtgttgtgacgtttcaataaataacacgtagcttattttgttggatgatggattgattgattttattgaccgttcgttcgcccggcggtgccgtcgccgcgcgcagagggaatatgcaagcgggcggggtggggaggaaagaaggtttcaggttccgggggttgggtctgcgtcgtccagggtggggctgatctgaatttcccgcagaacctcgaccagtaggtctgttgtgtttgctgggaactcgcccgccgttggggatacgggggcggggggtgtggtcgggcggacgtccaggggtgcgttatcgcacccccgcgccgcctcgggggccgtcccgtagatcgttgcggtgatgtagatggtgtccggggtccacaccaccgtcaggatgccggccgtcgcactccggacgctttcgccgtgcgatgagctgacccaggagtcaaaggggtacgcgtacatatgggcgtcccaccagcgctccagcctctgggtactagcgcgtcctataaagcggtatgcgcaaaattcggcacgacagtcgataatcaccagcagcccgatgggggtgtgttgtatcaccacgcctccgcggggcaggcggtcctggcgcgctcgaccccgcgtcagaaccgcgcgcgtccctgactcaaacacgtgcaccacctgtgccgcgtccggcagcgcgctcgttagcgacgccctggggtgatgtaggctgtacgcgatggtcgtctgggggttccccatgtctcgggggggtgggggtgaatgtcacccggcccgggtgcggtgggaacgcgagggaatggagggttaatagacaatgaccacattcggatcgcgtagagcagatagtatgtgctcgctaatgacgtcatcgcgttcgtggcgctcccggagcgggtttagattcatgtgcaggaactcggatgaggtggtgcgggacatggctacgtacgcgctgtttaggcgcaggtttccgggcgtgaagcatatggcgaccttgtccagactgagcccctgggagcgcgtgatggtcatcgcgagtttggagctgatgccgtagtcggcgttgatggccatggccagctccgtggagtcgatcgactcgacaaactcactgatgttggtattgacgacagacatgaagccgtgctggtcccgcaggacgatgtagggcaggggggactcctccaagaactcggccacgccggccgtcgcgtgccgccgccgcagctcctccgcgaacgcgaacacccgggtgtacgtgtaccccatcagcgtgtagttgtccgtctgcagggccacggacatcagccccccgcgcggcgagccggtcagcagctcgcagccccggaaaatgacattgtccacgtaggtgctgaagggggcgctctcaaacacctccccgaagagctcccgtaggataaggtatcgccccagaaaggccctcttcaggagcccaaactgggcgtggacggccgcggtggtctcaggctcttcgagggcgtagtggcagtagaacacgtccagctgctgttcgtccagcccggcgaagataacgtcaaggtcgtcgtcggggaagtcgtccgggcccccgtcccgcgggcccaggtgcttaaaattgaacgcacgctcccccggagagcggtcgctggtgtcggcggccctggttgccgatgcgccggcggcgtcccggcgtagcgacaggagttctgccgtcagctcccctaggcggccgtaggccagggtcctctgggtcgcgtccaggccggggcgctggagaaagttgtaaaagtgaatcagcccgccgaacatgagccgcgacaggaaccggtaggcgaactccaccgaggtctccccctgggtcttcacgaagctgtcgtcgcgcagcacagcctcgaaggtccgaaacgtcccgtcgaacccaaacaccatctttcggaggcgcgcggtcaccgcgacctggctgttgaggacgtacgtgatgtcgttccgggccacgactagctgttgcttgctgtgcacctcacagcgcacgtgccccgcgtcctggtcctgactctgggagtagttggtgatgcgactggcgttggccgtgatccacttttccatggtcagcgtgggttgctgcgtgagccgtcgatactcgtcaaactctttgaccgacacaaacgtgagcacggggagggtaaacacaacaaactccccctcgcgagtcacctttaggtaggcgtggagcttggccatgtacgcgctgacctccttgtgggacgagaacagccgcgtccaccccggaaggttggccgggttggtgatgtaactttccgggacgacaaagcggtccacaaactgcatgtgctcctcggtgatgggaaggccgtactccagcaccttcatgaggttcccgaactcgtgctccacacatcgcttgttgttaatgaaaatggcccagctgtgcgagaggcgcgtgtactcgcgtagggtgcggttgcagatgaggtacgtgagcacgttttcgctctgccggacggagcatcgcagtttttggtgttcgaaggtggactccagcgaggccgtctgggtcggcgaccccacgcacaccagcaccggccgcaggcggcccgcgtactggggggtgtggtacagggcgttaatcatccaccagcaatacaccacggtcgtgagtaggtgccgccccaggagcccggcctcgtcgatgacgataatgttgctgcgggtgaaagccggcagcgccccgtgtgtgaccgaggccaggcgcgtgagggcaccctggcccagccccaaagtctgctctagggcggtgagggcgtggaactcgtttcgcgcgtcttcgcccccgtgcgccgccagggcccgcttggtgatgtcgaggatcacctcccagtagtacgtcaggtctcgccgctgcaggtcttccagcgaggcggggctgctggccagggtgtacgggtgctgccccagctgggcctggacgtgattcccgcgaaacccgaactcgtgaaagatggtgttgatgggtcgactcagaaacgcccccgagagcttaacgtacatgttctgcgccgcgattcgcgtggcgcccgtgaccacgcagtccaggacctcgttgagggtctgcacgcacgtactctttccggatccggcgttgccggtgatgagatacgccgcgaacggaaactcccggagcggcaggccggtcgggacctccaaggccgccacgtcccggaaccactgcaggcgcggcacctgcgtgacgtcgagctgctgctgcgagagctctcggatgcgtgcgatgattggttggaccccgtgcatggacgtaaaatttaaaaacgcctcgtccctgaaccgcacggcgggtctggccccgggctgctgtgggggcggacctggtgcccggacgtcccgcgagccctccccgccggacgccgccatggccgcacagcgcgcgcgggcgccggcgatgcggacgcggggcggcgacgcggcgctatgcgcccccgaggacggctgggtgaaggttcaccccacccccgggacgatgttgttccgcgagattctcctcgggcagatggggtacaccgagggtcagggggtgtacaacgtcgtccggtccagcgaggccgccacccgacagctgcaggcggcgatcttccacgcgctcctcaacgccacgacgtaccgggacctggaggaggactggcgccgccacgtggtggcccgcggcctccagccgcagcggctggttcgcaggtaccggaacgcccgggagggcgatatcgccggggtggccgagcgggtgttcgacacgtggcgatgcacgctcaggacgacgctgctggactttgcccacggggtggtagactgctttgcgccgggcggcccaagcggaccgaccagcttccccaaatatatcgactggctgacgtgtctggggctggttcccatattgcgcaagacgcgcgagggggaggcgacgcagcgcctgggggcgtttctcaggcagcacacgctgccccggcagctggccacggtcgccggggccgcggagcgcgccggcccggggcttctggatctggccgtcgcgttcgactccacgcgcatggcggaatacgaccgcgtgcacatctactacaaccatcgccggggggagtggctggtgcgcgacccggtcagcgggcagcgcggcgagtgcctggtgctgtgcccccccctgtggaccggcgaccgcctggtcttcgattcgcccgttcagcggctgtgccccgagatcgtcgcgtgccacgccctccgggaacacgcgcacatctgccgtctgcgcaacaccgcgtccgtcaaggtgctgttggggcgcaagagcgacagcgagcgcggggtggctggcgccgcgcgggtcgtcaataaggcgctgggggaggatgacgagacgaaggccggctcggccgcctcgcgtctcgtgcggctcatcatcaacatgaagggcatgcgccacgtgggcgacatcaacgacacggtacgcgcctacttggacgaggcgggggggcacctgatcgacacccccgccgtcgaccacaccctccctgggttcggcaagggcggcaccggccgcgggtcggcgccccaggacccgggggcgcgaccgcagcagcttcgccaggcgtttcagacggccgtggtcaacaacatcaacggcatgctggagggctatatcaataatctctttggaaccatagaacgcctgcgagagacgaacgcgggtctggcgacccagctgcaggcgcgcgaccgcgagctgcggcgcgcccaggcgggggcgctggagcgggagcagcgcgcggcggaccgggcggccgggggaggcgcgggccgcccggcggaggcggatcttctccgggccgactacgacattatcgacgtcagcaagtccatggacgacgacacgtacgtggccaacagtttccagcaccagtacatccccgcgtacggccaggacctcgagcgcctgtcgcgcctctgggagcacgagctggtgcgctgcttcaagattctgcgccaccgcaacaaccagggccaggaaacgtcgatctcgtactctagcggggcgatcgcctccttcgtggccccgtatttcgagtacgtgcttcgcgccccccgagcgggcgcgctcatcaccggctccgatgtcatcctaggggaggaggagttatgggaggcggtctttaagaaaacccgcctgcagacgtacctgacagacgtcgcggccctgttcgtggcggacgtacagcacgcggctctgccccggcccccctccccaacccccgccgatttccgggcgagcgcgtccccgcggggcgggtcccggtcccggacccggacccgatcccggtcgcccgggagaacgccgaggggtgcgccggaccagggctggggcgtcgaacgcagggatggccgaccccacgcccgccgatgagggaacggccgccgccatcctcaaacaggccatcgccggggaccgcagtctggtcgaggtggcggaggggatcagcaaccaggcgctgctgcgcatggcctgcgaggtgcgccaggtcagcgatcgccagccgcggtttaccgcgaccagcgtcctgcgcgttgacgtcacccccagggggcggttgcggttcgttctggacgggagttccgacgacgcgtacgtggcgtcggaggattactttaagcgctgcggggaccagccgacgtatcgcggttttgcggtcgtcgtcctcacggccaacgaggaccacgtgcacagcctggccgtgccccccctcgttctgctgcaccggctctccttgtttcgccccacggacctccgggacttcgagctcgtctgcctgctgatgtacctggagaactgtccccggagccacgccacgccctcgctgttcgtcaaggtgtcggcgtggttgggggtcgtggcccgccacgcgtctcccttcgagcgcgtccgctgccttctcctccgcagctgccactggatcctgaacacgctaatgtgcatggcgggcgtgaagcccttcgacgacgagctagtcctgccccactggtacatggcccactacctgctggccaacaatccgccccccgtcctctcggccctgttttgcgccaccccgcagagctctgcgttgcagttgcccgggcccgtcccccgcacggactgtgtggcctataacccggccggcgtcatgggaagctgctggaattccaaggacctgcgttcggctctggtgtattggtggctttcggggagccccaaacgacggacctcgtcgcttttctatcggttttgctaactccggaaaataaacgtgttttttatggaacgttccccacctgtcgtgtcatctctcgggggatggtggtgggcctgtgtgtgtgtcttgtgcaccgaaggaggaaagtgggggggtggtggtgctggtggtggaaagacatgatagagggaacaaagaaatagaagaaaaccacaaccggcgcgtgccagtaaatacggacgcgcgcacacgcggggggtaagttggagcacggggccccggtttattgaccaaattcagggaaacagaaaccgcatcttttcctcgaaagggtacacaaagctcccgccctcgccccacacgccttccagaacccccgtaaacaccagttgaatctcgcgcaggatctcgcgcaggtgatgggcgcagtccacgggggggagcaccaagggccgcgggtacagatccacggggacgccgaccgactccccgcccccgggacatacgcgcacgacgcgtctccagtattgctccgcgtccagcagggcgcctccgcggaaggccgtttggggcagggggtcgtcggcctcgcctgggggggtcagaacgctccagtactccgcgtccagacgcctcccgaaggcatccaggacaaagcggtcacaggcgtcctccatgacgccccgggccgcgcacacggcctcctccggcgggccggcggccggccgccggaggattcgtctcagcgcgtcgcgcataacctcggccgccgcggcgtacgcgggcccgcggagaggaaatccctgcaggaagtcggtgtcatcgcgggagttccagaaccacgccccggtctggctccaggtgacgacgtgggtgtagacgccctctggcgccagggagggggcgaggcgcgggcgtatgccgttggccgaaagtacggcgcgcacggacgcctcgagggcccggcgggcgtcctggatcgcgccgtgcgcggcgtccgcgtccccggggtccacgttgaacagcccccagaacgcagccccggtgccgccgcagaccgcaaacttcaccgagctggccgtctgctcgatctgcaggcagacggcggccatgaccccgccgagcagctgccggagcgcggggcaggcgtcgcacgcgtccggcaccaggcgctccagcacggcccgggcccagggctccgagggggcggccgccaccagcgcgtccagcctttccaggcccgcccgcccccgggcttccggcagcccggcctccccgaggcccgcgagggcggccaggagctgggcctggagcccggagaaacaaaaccgcgccgtccagaccggcccgacggccgccggggggtcgagtagttggatggtggtggccgtggggtgccaccgcgccaccgcttcccgaaaggcgggcaggaggcggccggccgcctccgaggccacggccggccatgcccgcgggggcaggacgaccctggcgcccaccgcgggccaggcccccaggcacgcggcatgggtggccgcggcgccccgcaccaggtcacgcgccgactcggcggcggcggcggccggcacggtaaacgtgggccagcccggaaatcccagcacggcaaagtattggacgggccctccccggacctcaaacccgggccccagaaaagcgaagacgggggccagggctccgggggcggcgtggaccgtggtatgccactgccggaagagggcgaccagcgccggggcggagaacccgtcgccggcgctcacgaagtagtcgtagccgcgcggcagcagcacccgcgccgtgacccgctgcgggtgtccgcggggccgcaggccgacctcgcacacctcgaccaggtccgcgaaggcgccctccttcctggtcggcggaaacgccagggtggtgtattcgcgcgcaaaacgcgcggtcctcgtcgtgatggtgacggcgagcgaggcggaggacgcgcactgggggctgtcgcgaatggcggccaggcgcgcccacgccaaccgcgcgccggggtgctcggcgacgcgcgcggacagggccagcgggtcgacgtcgaccttggcctccacgtccaggagggcggcgcgaggagcggccggcgggccccacgacgccctttcgaccctcacgaccagacccgtctgcgggtcccagcccaggcgcagcgggacgaagagggccaccggccccgtctggcgctccagggccgccagaacgcacgcatacagcgcccgccacagggtcgggtcccccaggggctccagcggggaggcggccggggccgtcgcggcgcgggcggccgcgacggccccggcggccgagacgtcgggggagccgtagaagtcctgcaggtcggacgaaccaacggacacctccgcgaagcgcgcgcgcgcctcccccgcggcgtcgcgacagaccagatacagcagggcgtggaggcagtcgcgcgtgcgcgggggcagccataccgcgtatagggtaatggcgctgacgctctcctccacccaaacgatgccgggggcttccatgccacgacgcccgggggttgccgtgtatcgaacgagcgcggccccagacttatagggtgctaaagttcaccgccccctgcatcatgggccaggcctcggtgggaagctccgacagagccgcctcgagaatgatgtcagtgttgggctgggcgccggaggcgtgcgtgcgcaagcagcgcccccacgcgggcgcgcgcagcttgaagcgcgcgcccgcaaactcccgcttatgggccatcagcagcgcgtacagctgtctgtgcgtccggcaggcgctgtggtcgatgcggtgggcgtccagcagctccacgatggctcgcttggtgaggtttttaacgcgccccgccccgggaaacgtctgcgtgctcttggccagctgcaccccgaacagttcgccccagatgatcttgaacagcgacagcgcgtgctccgtctcgctcacggacccgcgcggggggcagccgctcagggcgtcggccacgcgcttaaccgcgtcctccgacagcaaggggccgtcggtcacgttacagtggcccagttcgaacaccagctgcatgtagcggtcgtagtgggggttcagcagctccagcacgtcctcggggctaaaggttcgccccgaccccccggccatcgagtcccactgcaggcacgcggccatggtgctgcacagacggaacagctcccagacgggggcgacgtttagggtggggtgtagggccacaagctccagctctccggcggcgttgatcgtggggatgacgcccgtggcgtagtggtcgtaaagccgccggaagatggcgctgctatgggcggccatggggacgcgaagacaggcctccagcagcaccaggtagatgaaccgcgtgcggccgaccaggctgttgaggccgcgcatgagcgcgaccacctcggccggcgcgacgtccggccggaggtacttttcgacgaaaaggcccacctcctccgtctcggcggcctgggccgacagggacgtgtcggggtcctggcagcgcagctcccgcagatcccgctgggccctcagggcatcaaaatgtatcccccgcaaaaacagacaaaagttcctcggggtcagcgcggcgtcgtggccccagaaccgcacgtgcatgcagttgagggtcagaagcatgtggaggatgttaagactgtccgcgaggcacgccagcgtgcacctctcgaagtagtgcttgtaccggaatttgctgtagatgcgcgacccccgcgcctgcgccgcgtcggcgtgcgacgcgtcgcagcgccctttgaaccggcggcacaacaggttcgtcacctgggaaaactgtgccggccactgcccgctggcgctcaccacgtggttgagcagcatgggcgtaaagacgggctccgagcgcgccccggacccgtccatgtagatcagcagctcccccttgcggagagtccgtacccgccccagcgactggtacacggacaccatgtccggcccgtagttcatgggtttcacgtaggcgaacatgctgtcaaagtgcggcggatcgaagctaaggcccaccgtcacgaccgttgtgtagatgaccacccggtaccggccccatgtggtcacgtcgccgggcggggtgagcgagtggagcagcagcacgcggtccgtaaactgccggcagaacctggcaacgacctccgcgaaggagaccgtcgacgagaagatgcagacgttatctccgccggccaggcgcgcctccagctccccgaagaaggtggcgtccgggggggcgtccggggggggcgccccgcccgccggccccggcgggcgcagggccgcctgcaggacctcgggccccaggcgcgggagaaacagacaacggcgcgccgaaaatccgggcatggcgtactccccgatgaccacgtgaacgttcttttcgccccggaggctgcacagaaagtccaccagctgcgcgttggcggtggcgtccatggcgatgatccgcgggcacgtgcgcagcaggcgcagcatcaacgcgtcgacgcggcccagctgctgcatcgtcggcgagtacagttggcccaacgtcgacatgacttcgtccaggacgagcacgtcgtagttgttcaacaggttcgggcccacgcgatgaagactttccacctgcacgatgagacggtggaaggggcggtcgttcatgatgtaattggtggatgagaagtaggtgacgaagtcgggcaaccctgactcagcgaaccgcgtcgccagggtctgagtaaaactccgacgacaggagacgaccagcacactcgtgtccggagagtggatcgcttcccccaaccagcggatcagcgcggtagtttttcccgagcccattggcgcgcggaccacagttacgcaccgggccgtcggggcgctcgcgtccgggaaggtgacgggtccgtgttgctgccgctcgatcgttgttttcgggtggacccggggaacccactcggccaaatcccccccgtaaagcatccgcgccagcgatacactcgacgtgtactgctcgcactcgtcatccccgatgggacgccgggcccccaggggatcccccgaggccgcgccgggcgccgacgtcgcgcccggggcgcgggcggcgtggtgggtctggtgtgtgcaggtggcgacgttcatcgtctcggccatctgcgtcgtggggctcctggtgctggcctctgtgttccgggacaggtttccctgcctttacgcccccgcgacctcttatgcgaaggcgaacgccacggtcgaggtgcgcgggggtgtagccgtccccctccggttggacacgcagagcctgctggccacgtacgcaattacgtctacgctgttgctggcggcggccgtgtacgccgcggtgggcgcggtgacctcgcgctacgagcgcgcgctggatgcggcccgtcgcctggcggcggcccgtatggcgatgccacacgccacgctaatcgccggaaacgtctgcgcgtggctgttgcagatcacagtcctgctgctggcccaccgcatcagccagctggcccaccttatctacgtcctgcactttgcgtgcctcgtgtatctcgcggcccatttttgcaccaggggggtcctgagcgggacgtacctgcgtcaggttcacggcctgattgacccggcgccgacgcaccatcgtatcgtcggtccggtgcgggcagtaatgacaaacgccttattactgggcaccctcctgtgcacggccgccgccgcggtctcgttgaacacgatcgccgccctgaacttcaacttttccgccccgagcatgctcatctgcctgacgacgctgttcgccctgcttgtcgtgtcgctgttgttggtggtcgagggggtgctgtgtcactacgtgcgcgtgttggtgggcccccacctcggggccatcgccgccaccggcatcgtcggcctggcctgcgagcactaccacaccggtggctactacgtggtggagcagcagtggccgggggcccagacgggagtccgcgtcgccctggcgctcgtcgccgcctttgccctcgccatggccgtgcttcggtgcacgcgcgcctacctgtatcaccggcgacaccacactaaatttttcgtgcgcatgcgcgacacccggcaccgcgcccattcggcgcttcgacgcgtacgcagctccatgcgcggttctaggcgtggcgggccgcccggagacccgggctacgcggaaaccccctacgcgagcgtgtcccaccacgccgagatcgaccggtatggggattccgacggggacccgatctacgacgaagtggcccccgaccacgaggccgagctctacgcccgagtgcaacgccccgggcctgtgcccgacgccgagcccatttacgacaccgtggaggggtatgcgccaaggtccgcgggggagccggtgtacagcaccgttcggcgatggtagccgtttcgttcgttttaataaaccgacgttgtgcgtttcaccatacttcggcgcgcgtgtgtgtgtgtttttttttttgtggtgtttattttccccccaccccttccttttctttcggccaccacccccctcctcccccgtactatacaacaaaaaataccacacatacgaccaaatacggacaatcatttctgtctttattcgctatcagagagtgggggcgtgagcgtggcaggagggcgggccacgtcggggtcccgccgtctggtgtgacgcgatggggggtccgatgcgcgccggtactggggccccggcgcccgggtgaccacgcgcacgtcggggggcacgtagaagttaccctcttcttcggactcgatgtccacgacgtcaaattcgtgggcggtcagcgagacgacctccccgccgtcggtggtgatgacgttgtgtcggcagcagcagggccgcgccccggagaacgcgaggcccataacttggcgagcgtatcgtcgaaggccaggcggctgtttcgccggatgtcccggtagatccccggctcgacgcggacgggggtgatgatcagggcgatcggaacggcctggtccgggaggatcgatgccttggcgggtccgggggccccgccacgcccggcgggcgctccgcggccgtcctccaggcggaacgtcacgccctcctccgcgcccgcgcggtgcctgccgaggaacgtcaccaggtgcggttgcagggggcagtcgggaaagtggctgtcgaggacgtatccctgcaccaagatctgtttgaagttcgggtggcgggggttggcgaagatgggctcgcggcgaaccagctccccggagctccaggccacgggagagatggtgcgacgctcaaggtcggggacgccaaacagaagcacctccgagacaacgccgctatttaactccaccagcgcccgatccggggcggagcatcgccttttttcgccggcggcgcgggaatcgagccagtcccggtcttgggtgacgagcgcctcctccgggcccggaacgcgcccgggcgcgaagtagcgcacgccggggttggggatggaccggatgaacgcccggaacgcctccggcgatcgccgcgccatcaggtcctcgtacgcggaggccgcgggggcgccggggtccgcggggtcgaacgcgtacttggctcggcacttaacctcgtagaaggccaggggggtctggggggcgggggccaggtagccgtgagggtccctggggcacacgaggatgtccagggacgcccccaccatgcccgtgtggccgtccatgaggaccccgcacgcgtgcacgttctcctcggcgaggtccccgggttggtgaaagacgaagcgcccggcgtcggcgtcgtcgttgacgcccgcgtccgcgcggcccacgcagtagcgaaacagcaggtttcgggccgtcggctcgttcacccgcccgaacatcaccgccgacgactgggcgtccagccgcaggctggcgttgtgggtgagccactgggacgagaagcacggaccctgcgcgccccaccgcagcgtggaggcggtcgtcaggccccgccgaagcagggcccagagctggcagtcggcctggttttgcgtcgccgcctcgtaaaatcccataagcgggcggggggcgacggcttcggcggcggacgggggggcgcggcgcgtcaggcgccagaggtgccggccgagcccgcggtccaccatgccggccgcctccagcgacacgacgagggagcacagatagtccaggcgagcccacaggggcccgatggccagaggggagcggacgccgcgcagcaggccgcgcaggtggcgctcgaacgtttccgccaagatatgggggggcagtgcgttggggatcgccgacgccgaccacatcgggtcggggtccgggggaccggggctgcagtccgggtcgatggcgtgtgcgccccccggcgagaggggaatgtcgggggttggcgggccggatgaggcctcagagagggccggggacgcgggccgggccttttcgcccggggccccgccgtcgggttgcccacgtggggggctctggggccaatgggaacccggggcccccggtgacgtggggcggggtggggcggggcggggcccaaagacggtcgccagatctaggctgttgggtcggggccgcttcgggggactatcggggtcgcgggcggggtccgcggggcgcttggcgccgggtgttgcggcggccgccatttttacgagcagccgaagagctcgagggcggaagggatcctcacgacagagagtggcgcgcggccgggttggcgtgacagaggcgggagaccagcaccagcagcggcctcagctcgggcggcagcgacaccgacgacaggacggccttgtgcgtgcgctggtaatttatacactgctccgtgaacgcgcgccgaatcttgggattgcgaaggtggcgccggatgccctccggcacgtcatacgccaggccgtgggtgttggtctcggccgagttgacaaagagggcggggtgcagaacgcagcgataggcgaggagggccacggcaaagtccggcgagagctggttgttaaagtactggtagcccgggacgcgggtcacggggacgcccaggctcggggccacgtacacgctaaccagcagctccagcagcgtctgccccagggcgtagagatcgaccgccagcccgacgtcgtgcttcagggggcggttgttaaactcggcccgctcgttgttgaggtactttaccgagagctccggtggctggttgtacccgtgccccaccagagtgtgaaagttggccgtggtcagggcggcgggcatcccaaacccccggggggactcgaggtccggctcctggaggcaaaactggccccgggatatcgtggagttggagttcagggtcaccaggctaaagtcggccaggacggcccgccggagcgacaccgcgtccgatcgcagcatcacgaggacgttggcgcacttgatgtccaggtggctgatcccgcacctggtgttcaggaacaccacggcgcgcgccaggtctgtgaagcagtggtggagggccgtcgcgacggagggggtggtcgcgcgcagggacgccagctggccgatgtacttgccgaggtccatgtcgtacgcggggaacacgatctggcgctgctgcagcgagaacccgagcggggtgataaagccgcggatgtcgtgggtgcggccgccgcgaagagcgcactcccccacgagcagggtcgcgacgagctccacggcaaaccactctttttcccggatggtcttcacggcgagcttgtgttcgcgaatcaactgcacctcgccgtacccccccgagcccccgaagctgcgggccccggggatctccagggtcgtgtagcggagggcggggttgacggcgaatacggggatgcatagcttgtggatgcgcgcgagggacaggatgtgcgaggggggcgacgggggcgaggtcatggccgtctcggacctgcgcaggggcgggcgccttagcttggccgcagggccgggggcctcgggggacgagcggcgacgagacgagcggctcactcgccatcgggacagtcccgcgcgaagccgctcccggaagctggatcggcggcgggacccggggcgggctccggagacggcgccgtctcggggggaggggccgcttgggcgtccggacgcccggcggctgagggagtgtatgtaggacgcgagccaggccttgaaggagcgtcggtgtgcaccttgggggctgatgtcagctgccacatgactagcaggtcgctgtcgcccggactcatccatccgtccgccaggtcgccgtccccccacagagacgcgttcgccgcggcctcttcgagctgctcctcctggtccgcaagacgatcgtccgccgcgtccaggcgctcgctaagcgcgggatcgaggtaccgtcggtgtgcggttagaaaatcacgtcgcgccgcttgctcttccacgcgaattttaacacaggtcgctcgctgtcgcatcatctctaagcgcgcgcgggactttagccgcgcctccaattccaagtgggccgccttggcggccataaaggcgccaacaaacctaggatcttgtgtactcacgccctcccggtgtagctgcagggtctggtccctgtacacctcggcccggaggtgcgtctcggccaaacgtcggcgcagggccgcgtggctggcgtctcggctcatctcgccgcccccgcgcgcgcccgacgtcggactccttcgccccgacccccctgacctcagccgcccccgcctcgcccgcgatgtttggccagcagctggcgtccgacgtgcagcagtacctggagcgcctggagaaacagaggcaacagaaggtgggcgtcgacgaggcgtcggcgggcctgacgctcggcggcgatgcgctgcgcgtcccttttttggattttgccaccgcgacgcccaagcgccaccagaccgtggtcccgggcgtcgggacgctccacgactgctgcgagcactcgccgctcttctcggccgtcgcgcggcggttgctgtttaatagcctggtgccggcgcaactcagggggcgtgactttgggggcgaccacacggccaagctggagttcctggcccccgagctggtgcgggcggtggcgcgcctgcggtttcgggagtgcgcgccggaggacgccgtgccccaacgcaacgcctactacagcgtcctgaacacgtttcaggccctgcaccgctccgaagcctttcggcagttggttcacttcgtgcgggacttcgcccagttgttgaaaacctcgttccgggcctctagtctcgcggagactacgggccccccgaagaaacgggccaaggtggacgtggccacccacgggcagacgtacggcaccttggagctcttccagaaaatgatactaatgcacgcgacctactttctggccgccgtgctgctcggggaccacgcggagcaggtcaacacgttcctgcggctcgtgttcgagatccccctgtttagcgacacggccgtgcggcacttccgccagcgcgccaccgtgtttctagtccccaggcgccacggaaagacctggtttttggtgcccctcatcgcgctgtcgctcgcgtccttccgggggatcaagataggctacacggcccacatccgcaaggcgaccgagcccgtgtttgatgagatcgacgcctgcctgcggggctggtttggctcgtcccgggtggaccacgtcaagggggaaaccatctcgttctcgttcccggacggctcgcgcagcacgatcgtgtttgcctccagccacaacacgaacgtaagtacgccttcctcccgcggtgcctgtttccccggtgccgccctccccgagatcgaccgacagacaaacacagccagacgcgagtgtgggacgacacgcccgcagccccccccccgccatggcgggggggaagccttactgtttatttgtaatcggacgatgaggctctggccacggcccgcgcgaccgcggggcagctcgttgcaaacaggcggctggtatacgatgacagaacgcagaggcgccacccggcgctggtcgggcggatgacgctttccgcgccgtcccggcccacgacgacctcgtgcaggtgggccgtgatgcgcgggcggcgggtcgcctgccgcaggataaccgcgtccacggggtgcccgaagaggagctgacacaggctcgcgtccccccggacggccagggtgcgctgggccatattggaccacatgcacggggcgacgcagggacaggcctccgccacggcgggggcgcgccacagcgcgttggcggaatcgatgtgggccgtcggggcgcaggcgccgcctcctcccggggggtcggtaatcctggatagcagccatcctaaatggcgggcccggctgcccgggggacagagcgaccccaggtcatcatccatggcccagcagtatatgcggccgccggggaggtgccaccaggcccccggacccagggcacagcacgcccccggattcgggggcggttccgtgggtaccaggtaggcgccgtcgagctcgtgggccacgggctcgtccgcgagctgttcggcggcggggtcgggggtttcctccgggggggaggcagcttccaggtggccgaaggctagggtgcacagcagcggggtccgggggtgcgttacgctgcggaggtggacggtggcgcagtagcggcgctcgcggttaaagaagaaaatggcaaagaacgtgttcgaaggcaggcgcagcgccttgggccgcgtcaggtacaggaagatctcgcagaaaagggcacgctcggggtcggggtccggaagggccacctggcacagcggctcggtgaggaccgtgaggcaccgaaaaatcttaagccgctcgtccccccgaacgacgcgccacacgaagacagagttggcgatgcgcgcgacgaggtcggcttcgggccccgggtcgggggcgcgcgcgtcggggggggcgccccggtgacccggcggggccgcggctcccggggggcctggcgtcgcctggggacgccagagtgcccgctgtgccaggttggtggtggggaagggaccggagacgcaccaaaagcagaggggccagcgcgtgtatgagttggggggggggtgggtgagcggtggaacaaaagcacgcgtcagcggacaaggccgggtcccgtagccgccccgcgacagaaccggagtccgacggcacgcgcgacggggtctgcgaggctgaggtacgccgcggtgttaatggtaaacgcaaagcctcccggaaagaccactagcccgcagaggcggcgattgaacccaaggcagaggtacgcgtagctctctcccggaaggtattgctcgcagaccctgtgtggggcagtggaggggctgccctccatgaagcgacatttactctgctcgcgtccattgacgtcaccgtcaatcaccactgcgattggacggttggtgaggcgcagcgtgtctccgctggtgctgtagtagtcaaacgcgtagtgggcgtcggagtcggcgaagcgggcggggatgtcgtcgctgagagggacgagccgccgccgccgcccccgaccgccctggccgcccagatgcgccagcacggccagggcgtacgcggtgtgaaagaacgcgtcgggggcggtcccctcgagggcgcgcatcaggttctccaggagcacggggaagcgccgcgtcacctcccctagccactcgctctggtgggggccaaagtcgtagcgcaggcgctggaagatgcgcgggccgccttggagcgcggcccggatagagtggcccagggcccgcagacacgcgatctggatgcgcgcgacgaaggccacctcggccgcgatgtcaaagggctgcagcacggggcgcgggtggcgcaggggtccctcgagcgcgggaaagcgacgcagcagcgccgtctgggccgcgggggacagctggtgggggcgcacgacgcgctcggcggcacaggcctccgtcagggccgtggccagctcggaggacagccgcggggggcgggcgcgtcgcccgccccacgccaccgaattctcgtaggagacgacgacgaagcgctgcttggtcccgtagtgatggcgcaggaccacggagatggagcgacggctccacagccagtcgggccggtcgccgccggccagagcttcccacccgcggtccagccactcgaccagcgatcgcggcttggcggtccccggcacgagggtgagcacgtcgttgaggacgtcctcgcccgcggcccgggggccccccggggtggcaaagcgccccccgccgggcggctccaggcccgccagcaccgcctccgcgtccgacgcgcccagggctcccccgctgacggcctggtggaccagggcgccctggcggagccccgaggcgacgccggaggccgcgtgcttggggcgcgcgcggaccgggtggcggcgggtgacgtcctgcacggcccgctggaccagcgcgaggatctcctcgttctcttgcgtgatggacacgtcctccgcggtggccgtgtcgcctcccggggccgtgagctgctcctccggggagatgggggggtctggggtgccgacaacggccggcccggccccgcccgagaccgaggacgcctggggagtgggggtgccgctttcccccatccccagggacaggtgggccgccgcctccgtcgcggcggcgggagccgcggcccccagccgcgcgacgtagcgacaaaagtggcgacagaggcgcatgaggcgcgcgccgtcggccgcgtatcgcgtgtttggcgggacgagctcgtcgtaactgaacaggagcacgcgggcgcaggtcgcccacgggccccacgccaggcgcagcgccgcgaccgtgtacgggtcgtacacgccttgggcgtcgcacgcgaccggcagggagacgaacagcccgcccgcgctggggacgcgcggcaggaggtccgggtgcgccgggatgacgggggctaggatcgcccccaccgcatccgccggcacgtaggcggcaaacgccgaacgccacggggtgcagtcgccggtcgcgtgggcccgggtctgggtttcgacccggaagttcgcggccgccccaccgtcggggcggccgcgcacgagggcggacagcgggacccccgccgccgccaggcactcgctggagatgatgacgtgaatcagcgaggcggggctgctcgggtcccgggtgagatcgtattggacctcgttggcaaagtgcgcgttcatggcccggccggcggtgcgagcccttcccggtgccggaaggggcgtgggtggggggtgcgtgtgcgcgtcctcggggcccgcgggcgcacgtgcgcttatacgctgtgtgtttcgtctgtccccagggaatccggggccaggactttaacctgcttttcgtcgacgaggccaactttattcgcccggatgcggtccagacgattatgggctttctcaatcaggccaactgcaagatcatcttcgtctcgtcgaccaacaccgggaaggccagcacgagctttttgtacaacctccgcggggccgccgacgagctgctcaacgtggtcacctatatatgcgacgaccacatgccgcgggtggtgacgcacaccaacgccacggcctgttcctgctatatcctgaacaaacccgtgtttatcacgatggacggcgccgttcgccggacggccgatctgtttctgcccgactccttcatgcaggagatcatcggggggcaggcccgcgagaccggcgacgaccggcccgtcctaacaaagtcggcgggggagcggtttctgctgtaccgcccctccaccaccaccaacagcggcctgatggcccccgagctgtacgtgtacgtggacccggcgttcacggccaacacgcgcgcctccggcaccggcatcgcggtcgtcgggaggtaccgcgacgatttcattatcttcgccctggagcactttttcctccgcgcgctcacgggatcggcccccgcggacatcgcccgctgcgtcgtgcacagcctcgcccaggtgctggcgctgcaccccggggcgtttcgcagcgttcgcgtggcggtcgagggcaacagcagccaggactcggccgtggccatcgccacacacgtgcataccgagatgcaccgcatcctggcctcggcgggggccaacggcccggggcccgagctcctcttctatcactgcgagccgcccggcggcgcggtattgtaccccttctttctgctcaacaaacagaagacgcccgccttcgaatactttatcaaaaagttcaactccgggggcgtcatggcgtcccaggagctcgtctccgtgacggtgcgcctgcagaccgacccggtcgagtatctgtccgagcagctcaacaacctcatcgaaaccgtctctcccaacaccgacgtccgcatgtactccggaaaacgcaacggtgccgcggacgacctcatggtcgcggtcatcatggccatttacctggcggccccgaccgggatccccccggccttttttccgatcacgcgcacgtcttgagtctttcttgccgtttcttttgtttctctttctttccccccctctctccgcaataaacgccttcccggaactgtgtttccccccctacaacagtgttgtccgttggttgggtggttggggtgcgggggtgggcgggggaagcaagaaaacggtcggcgaacacaacatcgggaaaacggattcccgcacgtgcgtcttcccagattcgacacacacaccccccttctccttaaataaacacaaaccacacgctcgttggttggttaatgccagcgctttatttacgtcttgttttttttgcgtttcctccgcgggtcccttcccaacacgcctgcccccgcctcaggggtagcggataaccggggccatgtcgccggattgcacaacggcggcgccgtcgaacgtacacacccgaaccgccggggccagggccaggatgtccccgagttggcccgcgtgcgccagccaggcgaccagcgcctcgtaaagcggcagcctgcgttcgccgtcctgcatcagcatgggggcttcggggtggatgagctgggcggcttctcgcgtgacgctctgcatctgcaggagcgcgttcacgtatccgtcctgggcgctcagcgcgagcagccgggggatgagcgtgaggatgagggtggttccttcggttatggagtagaccatgttgaggacgagcgaccgcagctcggtgtttacggaggcgagttgctggacgtcggccacgagcgagagacgggccccgttgtaatacagcacgttgaggtcggggagctccccgggcgtccgggggtcggggttgaggtcccggatgccccgggcgaccagccgcgcgactatctcgcgggccaggggcgttgggagcgggaccggaaaccgcagcgtgaggtccagcgactccaggcgcacgtccgtcgcctggccctcgaagacgggcgggacgaggctgacgggatccccgttgcagaggtcgacgggggaggtgttgcggagattgacggtgccggcgtgcgtgagccccaggtccacggggcaggcgacgattcgcgtgggcagcacccgcgtgattaccgcggggaagcgcctgcggtacgccagcaacaaccccaacgtgtcgggactaactcctccggagacgaacgattcgtgcgccacgtccgcgagcgccagctggcggcggatggtcggcagaaagaccactcgaccctcgcaccgctgcagcgccgcggcatcggggcgcgagatacccgaggggatcgcgatgtctgcttcgaaacaatccgtgatcatggcgccgggccgcgagacaccggaacgcgggggtgcgggagggccggaaagcgcaacgcaaccgggacgatgatgaaacagagatggggggcaccgaccgtgtgggagagggggcggggcagggctcagcagcacgcacggggaggtctgtcgtgcgcaggagccccaggtgagaatcagtcccccggagctcgggtctgggttttattgggacctgccctcggaatcgcggctcccagtccaagcccccctggggggggcggggacagggggtgtgtgtgggtaaaagcaacgtcggaaaatcaaacccaatgccccaaacaggaaaaaaaaagacgggcgggtggagggaaagctggggaagaagaagccaattttacagagacaggccctttagcggggaggcgtcgtagatgagatactgcgtaaagtgggtctctcgcgcgtgggcctccccatcgcgggcgctgcgtagcagggcggggtcgctggcgcaggtgatcgggtaggcttcctgaaacaggccgcacgggtcttccacgagctcgcggcaccccggcgggcgcttaaactgcacgtcgctggcagcggtggccgtggataccgccgatcccgtttccacgataagacgctccaggcagcgatgtttggccgtgatgtcggccgcggtgaagaacttgaagcaggggctgaggacgggcgaggccccgttgaggtgataggccccgttgtacagcaggtccccgtacgagaaccgctgcgacgcccacgggttggccgtggccgcgaagggccgcgccgggtcgctctggccgtggtcgtacatgagggctatgacgtccccctccttgtcccccgcgtacacgccgccggccgcgcgtccccgcgggttgcagggccggcgaaagtagttgatgtccgtggccacgggggtggcgatgaactcacacacggcatcctgcccgtggtccatgccggcgcgccgcggcacctgggcgcagccaaagaccgggaggggctgggccggccccagccggtttcccgccacgaccgcgttgcgcaggtacacggcggccgcgttgtctagcagcgggggggccccgcggccgaggtaaaagttttgggggaggttgcccatgtccgtaacggggttgcggacggtggccgtggccgcgacggcggtgtagcccacacccaggtccacgtttccgcgcggctgggtgagcgtgaagttgacccccccgcccgtttcgtggcgggccacctggagctggcccagaaagtacgcctccgacgcgcgctcggaaaacagcacgttctcggtcacgaagcggtcctgccgcacgacggtgaacccgaacccggggtggaggcccgtcttgagctggtgatacagggccacggggctcatcttgaagtaccccgccatgagcgcgtaggtcagcgcgttctcccccgccgcgctctcgcgggcgtgctgcaccacgggctggcggatggaggagaagtagttggcccccagggccggggggaccagggggacgtggcgcgccaggtcgcgcagggccggggggaagttgggcgcgttggccacgtggtcggcgcccgcaaacagcgcgtggacgggcaggacgtagaagtattcgccattttggatggtgtggtccaggtgctggggggccatgagcagcacgccggcgtgcagcgccccgtcgaagatgcgcatgttggccgtcgacgcggtgttggcgcccgcgtcgggcgccgcggagcacagcagcgccgtcgtgcgctcggccatgttgtgcgccagcacctgcagcgtgagcatggcgggcccgtcgacgacgacgcgcccgttgtggaacatggcgttgaccgtgttggccaccagattggcgggatgcagcgggtgggcggggtcggtcacgggatcgctcgggcactcctcaccgggggcgatctccgggaccaccatgttctgcagcgtggcgtacacgcggtcgaagcggacccccgcggtgcagcagcgcccccgcgagaaggccggcaccagcacgtaatagtagattttgtggtggacggtccagtcggccggccggtgcggccggtcgtcggcggcgtcggccgcgcgggcctgggtgttgtgcagcagccggccgtcgttgcggttaaagtcggccgtcgccacgttgcacgccgccgcgtagacgggctcgtgcccccccgcgtcaatccggcagtctcggtggcggtccagggccgcgtgtcgcataaggccgtcgcagtcccacacgaggggcggcagcagcgccgggtcgcgcatcaggtgattcagctcggcctgagcctgcccgcccagctccgggcccggcagggtaaagtcgtccaccagctgggccagggcctcgacgtgggccaccaggtcccgatacacggccatgcactcctcggggaggtcgcccccgaggtaggtcacgatgtacgagaccagcgagtagtcgttcacgaacgccgcgcatcgcgtgttgttccagtagctggtgatgcactgagtcacgagccgcgccagggcgcagaacacgtgctcgctgccgtgaatcgcggcttgcagcaggtaaaacaccgccgggtagctgcggtcctcgaacgccccgcggacggcggctatggtagccggcgccatggcgtggcggccaacgccgagctccaggccccgggcgtcacgaaacgccaccggacacagcgccaggggcaggttgccgttgaccacgcgccaggtggcctggatcgcccccggaccggccggggggacttcgccgccgggaagctcgacgtcggccacgcccgcgaagaagtcgaacgcggggtgcagctccagagccaggttggcgttgtcgggctgcatgaactgctccgcggtcatctggcactcggcgacccaccggacccggccgtgggcgaggcgctgccgccaggcgttcagaaaacgctgctgcatgtccgcgccggggccggccggggccgcgacgtacgccccgtacggattcgcggcctcgacggggtcgtggttcacgcccccgacggccgcgtcgatgttcatgagcgaaggatgacacacggtcccgaccgcgttctccatggacagccgcagaacctggtggtcctttccccaaaaaaacagctgccggggagggaacgcgcggggctccgggtggccgggggcgggcaccaggtccccggcgtgcgcggcgaagcgctccatggccgggttgaacagccccaggggcaggacgaacgtcaggtccatggcgcccaccagggggtagggcacgttggtggcggcgtagatgcgcttctccagggcctccaggaagaccagcctgtcgcctatggccaccagatccgcgcgcacgcgcgttgtctggggggcgctttcgagttcatccagcgtctcccggttcgcctcgagttgctcctcctgcatatccagcaggtggcggcccacgtcgtccaggctccgcacggccttgcccatcaccagcgccgtgacgaggttggccccgttcaagaccatctcgccgtaggtcaccggcacgtcggcctcggtgtcctccaccttcaggaaggactgcaggaggcgctgtttgatggcggcggtggtgaccagcaccccgtcgaccggccgcccgcgcgtgtcggcgtgcgtcaggcggggcacggccacggacggctgcgtcgccgtggtcaggtccacgagccaggcctcgatggcctcgcggcgatggcccgccttgcccaggaagaagctcgtgtcgcaaaagctccgcttcagctcggcgaccagggtcgcccgggcaaccctggtcgccaggcgcccgttgtcgagatatcgttgcatgggcaacagcagggccaggggaggcgccttctccaacagcacgtgcagcatctggtcggccgtgccgcgctcaaacgcccccaggacggcctggacgttgcgcgcgagctgctggatggcgcgcagctggcgatgcaggctaatgcccgtcccgtccagggcctcccccgtgagcagggcaatggcctcggtggccaggctgaaggcggcgttcagggcccggcggtcgatgaccttcgtcatgtaattatgcacgggctgctcgacggggtgcgggccgtcgcgggcgatgaggggctggtggacctcgaactgcacacgcccttcgttcatgtaagccagctccgggaacttggtgcacacgcacgccacggacaggccgagctccagaaagcgcacgagcgacagggtgttgcagtaggaccccagcagggcgtcaaactctacgtcatacaggctgttttcgtcggagcgcacgcgggcgaaaaaatcaaagagtctgcggtgggacgccacctcgatcgtactcaggatggagccggtgggcaccatggccgcggcgtaccggtaacccggggggtcgcgggcaggagcggccattgggttccttgggggattcgcaggctccatcaagccgagctcgggaaggccaagcccctcccgcacaacgcctcaccgccggcggacgcgactaacaacccacgggccgccaaaaccccaaggggcaacccgaccaacaacaggcgaggggaggaaaggcgtaaagggggcgttgggaggcaaaaagaaagaaaacacccagacgtaggcccgaggaccggccggcgtcctctgtccccgagcacccactgtgcccaacaggcacgggggcgagctgcccctgccttatatacccccccgccacacccccgttagaacgcgacgggtgccttcaagatggccctggtccaaaagcgtgctagaaaaaagttggtaaaggcggcaaagcagtccgccgccgccacccacatggcggcgccggccgcgcaggcgattcccagagaacgggcgcggaggggatccgtgcggggcagcagctggctggcggtgatccaatggaaaagcccgtcgggactgaacgtctcatgggcggccgccaccagggcgcacagggccgcgccgcccatgatcacgcacaacccccaaaacacgggtggcgacaacggcaggcgatcccgtttgatgttcacgtacaggaggagcgcccgtgccagccacgtgacatagtaggcgaggacggcggctataatacatgccggcgccaccgcccgtccggtccacccgtaatacatgcccgcggccaccagctccagcggcttgaggaccaggaacgaccaagcaaacatcaccacccgcttggaaaagaccggctgggtgtggggcggaagacgcgagtaggccgaactgacaaaaaaatcagacgtgccgtacgaggacagcgaaaactgttcatcgagcggcagttctccgtcctccccgccacacgcggcctcgtctaccagctcgcgatccaacaaaggaacatcatcccgcattgtcatggtcggtgcggggagccggcgaggcagcaaaaccgaaagtagtgctggcggcgcgggcccgggtccggacccaagcttcagggatggggggcggaggccaaaatcaaacaagcaccgcgcgggttctacacacaacccccacccgggtagtatccgcggatgcgagtgcctggcgaagtcacgtcccagcaggatataaacctcggccgttgggcccggaacccccgaaattcacacccacgccctgacgcccaaatcatgggtggatgtggttcgcgagccgcacatccgtgcgtccgccctcccccgcgggctgatgacgtggcggttagtcagtgggaaggcagggggaaagatgggttgggggaggaaacgaagaaaacacccagagggccacgtcgggaatgcgcccggagttgtccttaaaaggccggccgtgcgtgacggaagccgtcgtttgcccaagcaccgacgccgcgatccacagtggggggagttcctccgtccggccacaaccctacgcgcgggcggcacgcgcgagagcaacccacgggtcccgttcgcgccaccgccagcccttgctcccaccaccctcctcccaccaccccactattcccccccccaagtccgccccgtggctcgccggccatggagctcagctatgccaccaccctgcaccaccgggacgttgtgttttacgtcacggcagacagaaaccgcgcctactttgtgtgcggggggtccgtttattccgtagggcggcctcgggattctcagccgggggaaattgccaagtttggcctggtggtccgggggacaggccccaaagaccgcatggtcgccaactacgtacgaagcgagctccgccagcgcggcctgcgggacgtgcggcccgtgggggaggacgaggtgttcctggacagcgtgtgtctgctaaacccgaacgtgagctccgagcgagacgtgattaataccaacgacgttgaagtgctggacgaatgcctggccgaatactgcacctcgctgcgaaccagcccgggggtgctggtgaccggggtgcgcgtgcgcgcgcgagacagggtcatcgagctatttgagcacccggcgatcgtcaacatttcctcgcgcttcgcgtacaccccctccccctacgtattcgccctggcccaggcgcacctcccccggctcccgagctcgctggagcccctggtgagcggcctgtttgacggcattcccgccccgcgccagcccctggacgcccgcgaccggcgcacggatgtcgtgatcacgggcacccgcgcccccagaccgatggccgggaccggggccgggggcgcgggggccaagcgggccaccgtcagcgagttcgtgcaagtgaagcacatcgaccgtgttgtgtccccgagcgtctcttccgcccccccgccgagcgcccccgacgcgagtctgccgcccccggggctccaggaggccgccccgccgggccccccgctcagggagctgtggtgggtgttctacgccggcgaccgggcgctggaggagccccacgccgagtcgggattgacgcgcgaggaggtccgcgccgtgcatgggttccgggagcaggcgtggaagctgtttgggtcggtgggggctccgcgggcgtttctcggggccgcgctggccctgagcccgacccaaaagctcgccgtctactactatctcatccaccgggagcggcgcatgtcccccttccccgcgctcgtgcggctcgtcggtcggtacatccagcgccacggcctgtacgttcccgcgcccgacgaaccgacgttggccgatgccatgaacgggctgttccgcgacgcgctggcggccgggaccgtggccgagcagctcctcatgttcgacctcctcccgcccaaggacgtgccggtggggagcgacgcgcgggccgacagcgccgccctgctgcgctttgtggactcgcaacgcctgaccccgggggggtccgtctcgcccgagcacgtcatgtacctcggcgcgttcctgggcgtgttgtacgccggccacggacgcctggccgcggccacgcataccgcgcgcctgacgggcgtgacgtccctggtcctgaccgtgggggacgtcgaccggatgtccgcgtttgaccgcgggccggcgggggcggctggccgcacgcgaaccgccgggtacctggacgcgctgcttaccgtttgcctggctcgcgcccagcacggccagtctgtgtgagatatcccaataaagtgcagtcgttttctaacccacggatgccgttgtatgcctatacgggggactatggggggggaaaggaaaggaaacaggaatggagaagggaaaggaacagaggcggtagcggacgcacggcggacacaataacaaacagaccgcggacacggagggagtcggttgggttgggcgtggacgccgctgcgtccacacacccgtttattcgcgtctccacaaaaatgggacgcacgttcggaccaccctaaggatgcccgccagggccgcggtaatcataacgacccccagcgcggacgcggccagaaacccgggggcgatggtggcgatgggcagcgtgtcaaaggccagcagatgaatcacagttccgttggggaacaacaacagggccacggacggcacgtcgctggaaaacacgttcggggtgcccgccaccggcccctgggccagctgctgttgggtggcatccgtgtccaccagcagcaccgacatgacctccccggccggggtgtagcgcagaaacacggcccccacgaggccgaggtcgcgccggttttcggtgcgcaccagccgcttcggctcaatctcccgcgcgtgcccttcgcaggtggcggtgagataggtgataaacagcgggcggcggacgtcaacgcccgtaagcttgtatccgatcccgcggggcaagggggtgtgggtgacgacgtagctggcgttgtgggtgatgggcacgaggatccggggctccgcgttgtgcgacgggccgctacactggtgggtggcctccgggacgaaggcgcggatcagggcgttgtagtgcgcccagcgcgtgagaacggaggccacgccgcgggtctgttgtgccatgacgtccgccgggatgtcggatcgggtggccatggccagcgcgtccaggatgaacccgccctcggcgagatcgaagcgcagggaagctgcgcatggggaaaagtggtccgggagccagaagaggtttttctggtggtcggtcctggctagcgcggcccggagatcggcgtgggtcgccgcggcgacgtcggacgtacacagggccgtggttatgaggaggccccggcgggcgcgttcccgctgctcggccgagggcgcgcccgccaggaacggcgcccggaggacggccgtggcgtaaaacagcgctcggcggaccatcggggcggttagcgcgcggccgccgagaaactcggcgtacagggcgtcgatcaggcgggccgcgctcggggccaccgcgccataggccgcggggctgtccaacacgaacgccagctgatagcccagcgcgtgcgccgccaggctctgctctcgctcgaggatcgcggccaccagatgcccgaggcgcgcctccagccgcaggcgggccgccgggtccaacacggacacgttcaggaacaccgagtcggccgcgcagcccgctgctccccgggcggccaggccggccagcacgcgcgagtgggccaaaaagcccagcaggtcggagaggcgaatcgcgtcgtgggcgtgggccgcgttgacgaacgcaaaccccgacgaggcgagcagccccgcgaggcgccagaacagggacggacgcgcgtccgtgccggagcccgggtcctcccccaaaaactccgcataggcccgcgacatatactgggcgtagttcgtgctctcctcggggtagccggccacccgccggagggcgtccagcgccgagccgttgtcggcgggcgtcggggcccccaggacaaagacgcgatacctggggccggccggaggcccggggagcaccgcgggggcgttttcgtcggtcggatttccgacccgagcgagggtcttgtccgcaggcaccactatgatctcggccggagggctgtcccgcatcgatatcacgagccccatgaagcccttcccgtatcgcgcgcgcacgagcgcggcgtcgcacccgaacgccagcccgcccgtcgtccagacgcccacgggccacgtcgaggccgacggggagaggtacacgtaccgacccggagtccgtagcaggcccctggcggccagccaggtcacggatgcgttgtgcagatgcgcgatgctcaggttcgtcgtcggatgcctcggtgtccccgcgggcggccccgggggcggcgcgttgcgtcggccgtccgggtgcctctcggtcgccccgtcgtctccccgcgggaacgtaagcccctcgcggtccggcgcggccgcgaatgttacccaggcccgggaccgcaacagcgcggaggcgccggggttgtgcgacagtcccttgagctgggtcacctcggcggggggacgggacgtgggccccgcctcggggagctcgggcaggctcgcgttccgaggccggccgagcagataggtctttgggatgtaaagcagctgcccggggtcccgaggaaactcggccgtggtgaccaacacgaaacaaaagcgctcggcgtaccaccgaagcatgggcacggatgccgtagtcaggttgagttcgcccgggggcgccaagcgtccgcgctgggggtcgctggcgtcgggggtgttgggcaaccacagacgcccggtgtttgtgtcgcgccagtacgtgcgggccaaccccagaccgtgcaaaaaccacgggtcgatttgctccgtccagtacgtgtcatggcccccggcaacgcccaccaggacccccatcaccacccacagaccggggcccatggtcgtccgtcccggctgccagtccgcagatgggggggggtgtccgtacccacggcccaaagaggctccgcacctcggaggctatcggaggccctttgttgccgtaagcgcgggccaaaggatggggtggggtgagggtaaaagcacaaagggagtaccagaccgaaaacaaggacggatcggcccgctccgtttttcggtggggtgctgatacggtgccagccctggccccgaacccccgcgcttatggacacaccacacgacaacaatgccttttattctgttcttttattgccgtcatcgccgggaggccttccgttcgggcttccgtgtttgaactaaactccccccacctcgcgggcaaacgtgcgcgccaggtcgcgtatctcggcgatggacccggcggttgtgacgcgggttgggatcatcccggcggtgaggcgcaacagggcgtctcgacacccgacgggcgactgatcgtaatccaggacaaatagatgcatcggaaggaggcggtcggccaagacgtccaagacccaggcaaaaatgtggtacaagtccccgttgggggccagcagctcgggaacgcggaacagggcaaacagcgtgtcctcgatgcggggcagagaccccgcgccgtcctcggggtcggggcgcggggtcgccgcggcgacccccgtcagccggccccagtcctcccgccacctcccgccgcgctgcaggtaccgcaccgtgttggcgagtagatcgtagacacggcgaatggcggacagcatggccaggtcaagccgctcgcccgggcgttggcgtctggccaggcggtcggcgtgttcggcctccggaaggacacccaggaccaggttcgtgccgggcgcggtcgggggcatgagggccacgaacgccaacacggcctggggggtcatgcttcccatgaggtaccgcgcggccgggtagcacagcagggaggcgatagggtgccggtcgaaaacaagggtgagggccgggggcggggcttgcgggcccacagcctcccccccgatatgaggagccaaaacggcgtccgtcgccgcataaggcgtgctcattgttatctgggcgctggtcattaccaccgccgcctccccggccgatatctcgccgcggtccagacggtgctgcgtgttgtagatgttcgtcagggtctcggaggcccccagcacctgccagtaagtcatcggctcggggacgtagacgatattgtcgcgcggccccagggcctccatcagctgcgcggaggtggtggtcttccccaccccgtggggtccgtctatataaacccgcagcagcgtgggcagctccggatccccgcgggctccggaggccccctggcgatggctaggacgggacgccgcgcggccgtcggtaggcccgctcgcacgagcagcctgaccgaacgcaggcgcgtgctgttggccggcgtgagaagccatacccgcttctacaaggcgttcgcccgagaggtgcgggagttcaacgccaccaggatttgtggaacgctgctgacgctgatgagcgggtcgctgcagggtcgctcgctgttcgaggccacgcgcgtcaccttaatatgcgaagtggacctcgggccgcgccgcccagactgcatctgcgtgttcgaattcgccaatgacaaaacgttgggaggtgtgtgcgtcatcctggagctaaagacatgcaaatcgatttcttccggggacacggccagcaaacgcgaacagcggaccacgggcatgaagcagctgcgccactccctgaagctgctgcagtcgctcgcgcctccgggggacaaggtcgtctacctgtgtcctattttggtgtttgtcgcgcagcgtacgctgcgcgtcagccgcgtgacccggctcgtcccgcaaaagatctccggcaacatcaccgcggccgtgcggatgctccaaagcctgtccacgtatgccgtgccgccggaaccgcagacccggcggtcgcggcgccgggtcgccgcgaccgccagaccgcaaaggcccccctccccgacacgtgacccggaaggcacggcgggtcatccggccccaccagagagcgaccccccctccccaggggtcgtaggcgtcgctgcggagggtgggggtgtgcttcagaaaatcgcggcgcttttttgcgtgccggtggccgccaagagcagaccccggaccaaaaccgagtgaggttctgtgtgttgtttttttttttttttcctcgttttgttttctcttctttcccccccccctcccccgcttctggccaagcatcctcacctgcttaagcggaacccgcgggcgcgcggggactcatttgtcgccggcgacacccacccgacaacagcccctgggtgtcgaccgctgtcgcccccgtctgtcgcctctcccttttttccccccctcaaagaacgtggtgttgggcgccggccaattcttcccggagcgccgtcgtcgcccgcccgccgccctcgaacatggacccgtactaccctttcgacgcgctggacgtttgggaacacaggcgcttcatcgtcgccgactccaggagcttcatcacccccgagttcccccgggacttctggatgttgcccgtgttcaacatcccccgggagacggcggcggagcgggcggcagtgctgcaggcccagcgcaccgcggccgcggcggccctggagaacgccgccctccaggccgccgagctgcccgtcgacatcgagcgccggatacgcccgatcgagcagcaggtgcatcacatcgccgacgccctggaggcgctggagaccgcggcggccgcggccgaagaggcggatgccgcgcgggacgccgaggcgaggggggagggcgctgcggacggggcagcgccgtcgcccaccgcgggccccgccgccgcggagatggaggttcagatcgtacgcaacgacccgccgctacgatacgataccaacctccccgtggatctgctacacatggtgtacgcgggccgcggggccgcgggttcgtcgggagtcgtctttggtacctggtaccgcacgatccaggaacgcaccatcgcggacttccccctgaccacccgcagcgccgactttcgagacgggcgcatgtccaagaccttcatgaccgcgctggtcctgtctctgcagtcgtgcggccggctgtacgtgggccagcgccactattccgccttcgagtgcgccgtgctgtgtctgtatctgctgtaccgaaccacccacgagtcctcccccgatcgcgatcgcgctcccgttgcgttcggggacctgctggcccgcctgccgcgctacctggcgcgtctggccgcggtaatcggcgacgagagcggacgcccgcagtaccgctaccgcgacgacaagctgcccaaagcgcagttcgcggcggccggcggccgctacgagcacggggccctggccacccacgtcgtgatcgccacgttggtgcgccacggggtgctaccggcggccccgggcgacgttccccgagacaccagcacccgcgtgaaccccgacgacgtggcccaccgcgacgacgtcaaccgcgccgccgccgcgtttttggcacgcggccacaacctcttcctgtgggaggaccagacgctgctgcgggcgaccgccaacaccattacggccctggccgtgcttcggcggctcctcgcgaacggcaacgtgtacgcggaccgcctcgacaaccgcctgcagctgggcatgctgatcccgggagccgtcccggcggaggccatcgctcggggggcgtccggattggactcgggcgccataaaaagcggcgacaacaacctggaggcgctgtgcgttaactatgtacttccgctgtatcaggcagaccccacggtcgagctgacccagttgtttccggggctggccgccctgtgcctggacgcccaggcggggcggccactggcgtcgacgaggcgcgtggtggatatgtcgtcgggcgcccgccaggcggcgctcgtgcgcctcaccgcgctggagctcatcaaccgcacccgcacaaacaccacccctgtgggggagattattaacgcccacgatgccttggggatacaatacgaacagggcctggggctgctcgcccagcaggcacgcatcggcttggcgtcaaacaccaagcgattcgccacgttcaacgtgggcagcgactacgacctgttgtactttttgtgtctcgggttcattccccagtacctgtccgtggcctagggaagggtgggggtggtggtggtggggtgtttttctgttgttgtttctggtccgcctggtcacaaaaggcacggcgccccgaaacgcgggctttagtcccggcccggacgtcggcggacacgcaacaacggcgggccccgtgggtgggtaagttggttcgggggcatcgctgtattcccttgcccgcttccacccccccccccttcccgttttgtttgtttgtgcgggtgcccatggcgtcggcggaaatgcgcgagcggttggaggcgcctctgcccgaccgggcggtgcccatctacgtggccgggtttttggccctgtacgacagcggggacccgggcgagctggccctggacccagacacggtgcgtgcggccctgcctccggagaaccccctgccgatcaacgtagaccaccgcgctcggtgcgaggtgggccgggtgctcgccgtggtcaacgaccctcgggggccgttttttgtggggctgatcgcgtgcgtgcagctggagcgcgtcctcgagacggccgccagcgccgctatttttgagcgccgcggacccgcgctctcccgggaggagcgtctgctgtacctgatcaccaactacctgccatcggtctcgctgtccacaaaacgccggggggacgaggttccgcccgaccgcaccctgtttgcgcacgtggccctgtgcgccatcgggcggcgccttggaaccatcgtcacctacgacaccagcctagacgcggccatcgctccgtttcgccacctggacccggcgacgcgcgagggggtgcgacgcgaggccgccgaggccgagctcgcgctggccgggcgcacctgggcccccggcgtggaggcgctcacacacacgctgctctccaccgccgtcaacaacatgatgctgcgtgaccgctggagccttgtggccgagcggcggcggcaggccgggatcgccggacacacgtaccttcaggcgagcgaaaaatttaaaatatggggggcggagtctgcccctgcgccggagcgcgggtataaaaccggcgccccgggtgccatggacacatcccccgccgcgagcgttcccgcgccgcaggtcgccgtccgtgcgcgtcaagtcgcgtcgtcgtcttcttcttcttcttttccggcaccggccgatatgaaccccgtttcggcatcgggcgccccggcccctccgccgcccggcgacgggagttatttgtggatccccgcctctcattacaatcagctcgtcaccgggcaatccgcgccccgccacccgccgctgaccgcgtgcggcctgccggccgcggggacggtggcctacggacaccccggcgccggcccgtccccgcactacccgcctcctcccgcccacccgtacccgggtatgctgttcgcgggccccagtcccctggaggcccagatcgccgcgctggtgggggccatcgccgccgaccgccaggcgggtgggcttccggcggccgccggagaccacgggatccgggggtcggcgaagcgccgccgacacgaggtggagcagccggagtacgactgcggccgtgacgagccggaccgggacttcccgtattacccgggcgaggcccgccccgagccgcgcccggtcgactcccggcgcgccgcgcgccaggcttccgggccccacgaaaccatcacggcgctggtgggggcggtgacgtccctgcagcaggaactggcgcacatgcgcgcgcgtacccacgccccctacgggccgtatccgccggtggggccctaccaccacccccacgcagacacggagacccccgcccaaccaccccgctaccccgccaaggccgtctatctgccgccgccgcacatcgcccccccggggcctcctctatccggggcggtccccccaccctcgtatcccccagttgcggttacccccggtcccgctcccccgctacatcagccctcccccgcacacgcccacccccctccgccgccgccgggacccacgcctccccccgccgcgagcttaccccaacccgaggcgcccggcgcggaggccggcgccttagttaacgccagcagcgcggcccacgtgaacgtggacacggcccgggccgccgatctgtttgtgtcacagatgatggggtcccgctaactcgcctccaggatccggacttggggggggtgtgtgttttcatatattttaaataaacaaacaaccggacaaaagtatacccacttcgtgtgcttgtgtttttgtttgagaggggggggtggagtgggggggaaagtgggccgaatgacacaaaaattaggtcggaggggtgaggggggggggctaggagccgaaccgatggcccccacacgcgacggaaggcccggaagactaccacggggagggggtgtggaaagcgaccggtcgcagggagacggggttggtttggggttggtttggggttggttttcccgttagcacatgtctgcatttgtttttctagtcacacgccccccccccccaaataaaaaccaaggcaaaacaataccagaagtcatgtgtatttttgaacatcggtgtctttttatttatacacaagcccagctcccctcccctcccttagagctcgtcttcgtctccggcctcgtcctcgttgtggagcggagagtacctggctttgttgcgcttgcgcagaaccatgttggtgaccttggagctgagcagggcgctcgtgcccttctttctggccttgtgttccgtgcgctccatggccgacaccaaagccatatatcggatcatttctcgggcctcggccaacttggcctcgtcaaacccgcccccctccgcgccttcctccccctccccgcccacgcccccggggtcggaagtcttgagttccttggtggtgagcggatacagggccttcatgggattgcgttgcagttgcaggacgtagcggaaggcgaagaaggccgcgaccaggccggccaggaccagcagccccacggcaagcgccccgaaggggttggacataaaggaggacacgcccgagacggccgacaccacgccccccactactcccatgactaccttgccgaccgcgcgccccaagtcccccatcccctcgaagaacgcgcacagccccgcgaacatggcggcgttggcgtcggcgcggatgaccgtgtcgatgtcggcaaagcgcaggtcgtgcagctggttgcggcgctggacctccgtgtagtccagcaggccgctgtccttgatctcgtggcgcgtgtagacctccaggggcacaaactcgtggtcctccagcatggtgatgttcaggtcgatgaaggtgctgacggtggtgacgtcggcgcgactcagctggtgagagtacgcgtactcctcgaagtacacgtagcccccgccgaagatgaagtagcgccggtggcccacggtgcacggctcgagcgcgtcgcgggtgaggcgcagctcgttgttctcgcccagctgcccctcgatcagcgggccctggtcttcgtaccgaaagctgaccagggggcggctgtagcacgtccccggccgcgagctgacgcgcatcgagttctgcacgatcacgttgtccggggcgacgggcacgcacgtggagacggccatgacgtctccgagcatgcgcgcgctcacccgccggccgacggtggcggaggcgatggcgttggggttgagcttgcgggcctcgttccagagagtcagctcgtggttctgcagctcgcaccacgcgacggcgatgcgccccagcatgtcgttcacgtggcgctgtatgtggttatacgtaaactgcagccgggcgaactcgatcgaggaggtggtcttgatgcgctccacggacgcgttggcgctgggcgcctcccgcagtggcgcgggcgtggcattccggggcttgcggtcctgctcccgcatgtactcccgcacgtacagctcggcgagcgtgttgctgaggaggggctggtacgcgatgaggaagccccccgtggccaggtagtactgcggctggcccaccttgatgtgcgtggcgttgtacttgcgcgcaaacatgcggtcgatggcctcgcgggcatcccggccgatgcagtcgcccaggtcgacgcgcgagagcgagtactcggtcaggttggtggtgaaggtggtcgagatggcgtcggaggagaagcggaaggagccgccgtactcggcgcggagcatctcgtccacctcctgccacttggtcatggtgcagaccgccggtcgcttcggcacccagtcccaggccacggtaaacttgggggtcgtcagcaagttgcgggtcgtcggcgacgtggcccgggccttcgtggtgaggtcgcgcgcgtagaagccgtcgacctgcttgaagcggtcggcggcgtagctggtgtgctcggtgtgcgacccctcccggtagccgtaaaacggggacatgtacacaaagtcgcccgtcgccagcacaaactcatcgtacgggtacaccgaccgcgcgtccacctcctcgacgatgcagttgaccgtcgtgccgtaccgatggaacgcctccacccgcgaggggttgtacttgaggtcggtggtgtgccacccccggctcgtgcgcgtggcgaccttcgccggcttgagctccatgtcggtctcgtggtcgtcccggtgaaacgcggtggtctccatgttgttccgcacgtacttggccgtggagcggcagacccccttggcgttaatcttgtcgatcacctcctcgaagggaacgggggcgcggtcctcgaatatccccataaactgggagtagcggtggccgaaccacacctgcgacacggtcacgtctttgtagtacatggtggccttgaatttgtacggggcgatgttctccttgaagaccaccgcgatgccctccgtgtagttctgcccctccgggcgcgtcgggcagcggcgcggctgctcaaactgcaccaccgtggcgcccgtcgggggcgggcacacgtaaaactgggcatcggcgttctcgaccttgatttcccgcaggtgcgcgcgcagcgtggcgtggccggcggcgacggtcgcgttggcgtcggggggcggggtcgcctcgggccgcttgggcggctttttggttttccgcttccgggccttggtggtcgcggggctcgggacggggggcggccgggaggcgggacccccgttcgccgcgacggtcgcggccacgccgcccgaggcgcggggggccgccggggccgccggggccgccgacgccaccgcggccaccagcgcccccacgaccagcgcgcaaatcaagccccccccgcgcatggcgggcctacgggggcgcgtcgctcccgccgcccgctagtctgggggcgaggtgctgcaggaccgagtagaggatggaaaaaacgtctcggtcgtaaaccacgaccgagcggggtccgatgcagccgtcggggccgctctcgacgatggccaccagcggacagtcggagttgtacgtgaggtacacgcccggcgggtagcggtacagaccttcggaggtcgggcggctgcagtcggggcggcgcaactcaagctccccgcaccggtagaccgacgcaaagagtgtggtggcgataatgagctcgcgaatatatcgccaggcggcgcgctgggtgggcgtgattccggaaacaccgtcaaaacagtagaacttttgaaactcgctgacggcccaatcagcgcccgaaccccccgcgcccatgatgaagcgggcgagttcctccttgaggtgcggcaggagccccacgttctcgacgctgtagtacagcgcggtgttggggggctgggcgaagctgtgggtggagtggtcgaacaggggcccgttgacgagctcgaagaagcgatgggtgatgctggggagcagggccgggtccacctggtggcgcagcagcgacgctcgcatgaaccggtgcgcgtcaaacacgcccggggcggcgcggttgtcgatgaccgtgcccgcgcccgccgtcagggcgcagaagcgcgcgcgcgccgcgaagccgttggcgaccgcggcgaaggtcgcgggcagcacctcgccgtggacgctgacccgcagcatcttctcgagctccccgcgctgctcgcgcacgcagcgcccgaggctggccagcgaccgcttggtcaggcggtccgcgtacagccgccggcgctcccgcacgtccgcggcggcccgcgtcgcgatgtcgccccagctctccggcccctgcgcccctggctcggggccgcgctccccgtcctcgctcgcgggcgtccccgcgccacgcctccgccccccctcctccgcggcggcccggggctcttcctcctcggcccccccggtcgcgccgccggcccccagccgcgccagcacgcggcgcagcgcctcctcgtcgcactgctcggggctgacgagccgccgcagcagcggcgtcgtcaggtggtggtcgtagcacgcgcgtatcagcgcctcgatctgatcgtcgggcgacgtcgcctggccgccgatgatcagggcgtccaccatgtccagcgccgccaggtggcccccgaacgcgcgatcgaagtgctccgcccgccgcccgaacagcgccagctccacggccaccgcggcggtctcctgctgcagctcgcgctgcgccagcgcgttcaggttgtcggcgaaggcgtccatggtggagtggcgggcgcgatcgccggacgccagccagaagcgcagctcgctgatggcgtacaggccgggcgtagtggcctgaaacacgtcatgcgcctccagcagggcgtcggcctcctcgcggacagaagagctatcggcgggcggcgggccggcccgggccccgccgcccgccgcggtccgcgccagcgcctggtccagcacacagagcgctcgcgcgcgggcggcgtccgacagcccggcggcgtggggcaggtaccgtcgcagctcgttggcgtccagccgcacctgggcctgttgggtgacgtggttacagatgcggtccgccaggcggcgggcgatggtcgccccctggttcgcggtgacgcacagctcctcgaaacagaccgcgcacgggtgggacgggtcgctcagctccgggggcacgatgaggcccgaccccaccgccgccaccataaactcccggacgcgctccagcgcggccgtggcgccgctcgggggggtgatgaggtggcagtagttcagctgcttgagaaaattctcgacatcatgcaggaagcacagctccatgcggacgtccccgccgtacgtctgcagccggatctgctggtggtacggacagggtcgggccagacccatggtctcggtgaaaaaggcagagacgtcacccgtggtcgcgaacgtttccaggtggcccaggagccgctccccctcgcgccacgcgtactccaggagcaactccagggtgaccgacagcggggtgagaaaggcggcggcctgagcctccagccccggccgcaggtgccgccgcagcacgcgcacctggagcgcgttgagctttagctgggcgagcttccccaggccgatctgggggtcgcatcgtcgaagcagctctagctgaaaaacgtacgtctgtacctgcccgagcagggccaacagtttctgtcgggccgcagtgggctcggaaaccgcggccgggggcgcggccgccatggcgagtcacccggccgtgctgtggtttagttaaggtttgggggggggtgggtcagaggcgcgccccgcgcggactgatgcggcggcgggcccctgacatcccctctttatgcccgtcgcccgcccgcccgccccgccggtgtgccgtgattcgcggagtcggggccttgtgtttctttctttcccccccgaatccgttctttcttcctcacccccccctccccacacacccacccaggactcgccaccacaaggaggcgagagcccgtcgctaacccaaagacacagtcacgagacacgatatcgactgtagttgcgatcgtttattttatacacaacaccaacctttccttcgaccccccccacccccgcccctagagcatatccaacgtcaggtcctttttctccggtggtccctccccaaacggatcgtcgccgtgaaacgcccgctttcgggcgacgccggccgcccccgccgccgccgccaaaccgccgaacgacgccgcgtggtcatcctcgtcgccgaaatccccaaagttaaacacctccccggcggcgccgagctggctgaccagggcctccgcctcgtgggccacctccagggccgcgtcggtcgaccactcgccgtgcccgcgctccagggcgcgggtggtaaactccatcatttcctcgctcaggtactcgtcctccagcagcgccagccagtcctcgatctgcagctgctgggtgcgggggcccaggctcttgacggtcgccacaaacacgctgctggcgaccgccgccccgccctccgcaatgatgccccggagctgctcgcacagcgaatgctcgtgggccccgcccccgagactcgacgccgcgcacacaaacccggccctggggcaggccaggacaaacttgcgggtgcggtcaaagatcagcagcgggcacgcgtttttgccgcccagcaggctggcccagttcccggcctgaaacacgcggtcgttgccggccatgccgtagtatttgctgatgctgaggcccagcacgaccatcgggcgcgcggccatcacgggccgcagcaggttgcagctcgcgaacatggacgtccaggcgccggggtgcgcgtcgagggagtccatcagcgcgcgggccccggcctccaggcccgcgccgccctgcggggcccaggcggccgccgcctgcacgctggggggacggcgggacccggcgatgacggccgtgagggtgtttatgaagtacgtcgagtggtcgcagtacctcaagatctggttggccatgtagtacatggccagttcgctcacgttattgggggccaggttgataaagttaatcgcgccgtagtccagggagaacctcttaatgaacgcgatggtctctatgtcctcgcgcgacaagagccgggcggggagctggttgcgctggagggcggtccagaaccactgcgggttcggctggttcgaccccgggggcttgccgttgggaaagatgaccgcgtggaactgcttcagcaggaagcccagcggtccgaggaggatgtccacgcgcttgtcgggcttctggtaggcgctctggaggctggcgacccgcgccttggcggcctcggacgcgttggcgctcgcgcccgcgaacaacacgcggctcttgacgcgcagttccttgggaaacccaagggtcacgcgggcaacgtcgccctcgaagctgctctcggcgggggccgtctggccggccgttaggctgggggcgcagatagccgccccctccgagagcgcgaccgtcagcgtcttcgccgacaggaacccgttgttgaacaggtccatgacgcgccgccgcagcaccggttggaattgattgcgaaagttgcgcccctcgaccgactgcccggcgaacaccccgtggcactggctcagggccaggtcctggtacacggcgaggttggaccgccgcgcgaggagctgcagcagggggcacggcccgcaggtgtacgggtccagcgacagcgacatggcgtggttggcctcggccagaccgtcgcggaacttaaagttgcgcccctcgatcaggttgcgcatcagctgttccacctcgcgatccaccagctgcttgatgttgttcaccaccgtgtgcagggcctcgcggttgccgataatcgtctccagcctccccagggccgtgggcaccgcctggtccacgtactgcagggcctcgagctcggccatgacgcgctcggtggccgcgcggtacgtctcctgcatgatggtccgggtgttctcggacccgtccgcgcgcttcagggccgagaaggcggcgtagttccccagcacgtcgcagtcgctgtacgcgctgttcatcgttccgaagaccccaatggccccccgggcggcgctcgcgaacttggggtggcgggcccgcagccgcatcagcgtcgtgtgcgcgcaggcgtggcgggtctcgaaggtacacaggttgcagggcacgtcggtctggcccgagtccgcgacgtagcgaaacacgtccatctcctggcgcccgacgatgactccgccgtcgcagcgctccaggtaaaacagcatcttggccagcagggccggagagaacccgcacagcatggccaggtgctcgccggcgaactcctgggttccgccgacgaggggcgccgtggggcgcccctcgtacccgggcaccacgtggccctcgcggtccagctgcgggttggccgccacgtgcgtgccgggcacgagaaagaagcggtaaaaggagggcttgctgtggtccttggggtccgccggcccggcgtcgtccacctcggtcaggtggagggccgaattggtgctgaacaccatggcgcccacgaggcccgcggcgcgcgccaggtacgccccgacggcgccggcgcgggccgcgggcgtttcctggccctcaagcaggggccacgtggtgatgtcggggggcggctcgtcaaagaccgccatcgacacgatggactccagggccagggcggcgtcgcccgccatcaccgaggccaggcgctgctcaaacccgcccgccgggcccttgttcccggcgtcgcgcgcgccccgctggggcttaccctggctggcctcgaaggccgtgaacgtaatgtcggcggggagggccgcgccctcgtggttttcgtcgaacgccaggtgggcggccgcgcgggccacggcgtccacgttccgggcacgcagggccacggcggcgggcccgacgaccgcctcgaacagcaggcgggcgagggggcggttgaaaaacggaagggggtagttgaaattctccccgatcgatcggtggttgcagttaaacggatcggcgatgacccggctaaaatccggcataaacatctgcagcggatacacggggatgcggtgaacctccgcgtccccgatggttaccttgtccatcccgcccagatgcaggaaggtgttgctgatgcacacggcctcccggaagccctccgtgatcaccagatacagcaaggcccggtccgggtccagtccgagccgctcgcacagcgcgtcccccgtcgtctcgtgctttaggtcgcagggccggggcgcgtagtccgcgaagccaaaatggcggcgcgcccgctcgcagagccgcgtcaggttgggggcctgggtgctgggggccaggtggcggccgccgtgaaagacgtaaacggacgggctgtagtgcgagggcataagcttgagggacaccgcggtccccccaaggcccgtcgtgcgggacccgacgaccgcggccacgttggcctcaaacccgctctccacggtcaggccgacgatgaggggcgcgacggcgacgtccgcgtcgccgctgcgcgccgacagtagcgacagcagctccaggccttcggccggacaggcgcggccatacacgtaccccatcggccccggaggaaccttgacggtggtcgtcgttttgggcttggtgtccatggctttcgggagatcggcgaccggcaggaacgggggcccggcaagacgaccgggggcagacgggggaggccgcgcgtggtcgacggctgctgcccgccgtcgtctctccgatggggtcgaatgccggcgctgggggtggggtctacacccgcccgttcgccgagcggcccctggtgggggtgggatgggtgggatggggtgggcgagaatggcccgccaccggatcgcgccggacgggggggcccggggttgggcaaggtttgggcgcaaggctccagcggcgattcgagaggcctgcggatggcggcccagagctgggtatgctcggccggggcggccggtatatgtacggcgtgctgggaggggcggcgtcgggccccgcccacggtccgccacgccccgcgcgtcatcggcagggggcgtggccgcccttctaaaaaaagtgagaacgcgaagcgttcgcactttgtcctaataatatatatactattaggacaaagtgcgaacgcttcgcgttctcactttttttagaagggcggccacgccccctttgacgtcacgctcacccgggcggccggccgcccataagcgcggcctgccgggccgataaaaagaaaccgcggcgcccccgcggacaccacacactggctctcgaaccccggacgcgcagaagggacccgggcgcgggtccgccggtaagagccggggggaacatcggcaccgccatcccaccccgagctgttgggtgggcgggtgggggggctggtgaggcggtggtgggagggggcggcgtatagcaggacaacgaccggcggcgatgttttgtgccgcgggcggcccggcttcccccggggggaagccggcggctcgggcggcgtctgggttttttgccccccacaacccccggggagccacccagacggcaccgccgccttgccgccggcagaacttctacaacccccacctcgctcagaccggaacgcagccaaaggccctcgggccggctcagcgccatacgtactacagcgagtgcgacgaatttcgatttatcgccccgcgttcgctggacgaggacgcccccgcggagcagcgcaccggggtccacgacggccgcctccggcgcgcccctaaggtgtactgcgggggggacgagcgcgacgtcctccgcgtgggcccggagggcttctggccgcgtcgcttgcgcctgtggggcggtgcggaccatgcccccgaggggttcgaccccaccgtcaccgtcttccacgtgtacgacatcctggagcacgtggaacacgcgtacagcatgcgcgccgcccagctccacgagcgatttatggacgccatcacgcccgccgggaccgtcatcacgcttctgggtctgacccccgaaggccatcgcgtcgccgttcacgtctacggcacgcggcagtacttttacatgaacaaggcggaggtggatcggcacctgcagtgccgtgccccgcgcgatctctgcgagcgcctggcggcggccctgcgcgagtcgccgggggcgtcgttccgcggcatctccgcggaccacttcgaggcggaggtggtggagcgcgccgacgtgtactattacgaaacgcgcccgaccctgtactaccgcgtcttcgtgcgaagcgggcgcgcgctggcctacctgtgcgacaacttttgccccgcgatcaggaagtacgaggggggcgtcgacgccaccacccggtttatcctggacaacccggggtttgtcaccttcggctggtaccgcctcaagcccggccgcgggaacgcgccggcccaaccgcgccccccgacggcgttcggaacctcgagcgacgtcgagtttaactgcacggcggacaacctggccgtcgagggggccatgtgtgacctgccggcctacaagctcatgtgcttcgatatcgaatgcaaggccgggggggaggacgagctggcctttccggtcgcggaacgcccggaagacctcgtcatccagatctcctgtctgctctacgacctgtccaccaccgccctcgagcacatcctcctgttttcgctcggatcctgcgacctccccgagtcccacctcagcgatctcgcctccaggggcctgccggcccccgtcgtcctggagtttgacagcgaattcgagatgctgctggccttcatgaccttcgtcaagcagtacggccccgagttcgtgaccgggtacaacatcatcaacttcgactggcccttcgtcctgaccaagctgacggagatctacaaggtcccgctcgacgggtacgggcgcatgaacggccggggtgtgttccgcgtgtgggacatcggccagagccactttcagaagcgcagcaagatcaaggtgaacgggatggtgaacatcgacatgtacggcatcatcaccgacaaggtcaaactctccagctacaagctgaacgccgtcgccgaggccgtcttgaaggacaagaagaaggatctgagctaccgcgacatccccgcctactacgcctccgggcccgcgcagcgcggggtgatcggcgagtattgtgtgcaggactcgctgctggtcgggcagctgttcttcaagtttctgccgcacctggagctttccgccgtcgcgcgcctggcgggcatcaacatcacccgcaccatctacgacggccagcagatccgcgtcttcacgtgcctcctgcgccttgcgggccagaagggcttcatcctgccggacacccaggggcggtttcggggcctcgacaaggaggcgcccaagcgcccggccgtgcctcggggggaaggggagcggccgggggacgggaacggggacgaggataaggacgacgacgaggacggggacgaggacggggacgagcgcgaggaggtcgcgcgcgagaccgggggccggcacgttgggtaccagggggcccgggtcctcgaccccacctccgggtttcacgtcgaccccgtggtggtgtttgactttgccagcctgtaccccagcatcatccaggcccacaacctgtgcttcagtacgctctccctgcggcccgaggccgtcgcgcacctggaggcggaccgggactacctggagatcgaggtggggggccgacggctgttcttcgtgaaggcccacgtacgcgagagcctgctgagcatcctgctgcgcgactggctggccatgcgaaagcagatccgctcgcggatcccccagagcacccccgaggaggccgtcctcctcgacaagcaacaggccgccatcaaggtggtgtgcaactcggtgtacgggttcaccggggtgcagcacggtcttctgccctgcctgcacgtggccgccaccgtgacgaccatcggccgcgagatgctcctcgcgacgcgcgcgtacgtgcacgcgcgctgggcggagttcgatcagctgctggccgactttccggaggcggccggcatgcgcgcccccggtccgtactccatgcgcatcatctacggggacacggactccattttcgttttgtgccgcggcctcacggccgcgggcctggtggccatgggcgacaagatggcgagccacatctcgcgcgcgctgttcctccccccgatcaagctcgagtgcgaaaaaacgttcaccaagctgctgctcatcgccaagaaaaagtacatcggcgtcatctgcgggggcaagatgctcatcaagggcgtggatctggtgcgcaaaaacaactgcgcgtttatcaaccgcacctccagggccctggtcgacctgctgttttacgacgataccgtatccggagcggccgccgcgttagccgagcgccccgcagaggagtggctggcgcgacccctgcccgagggactgcaggcgttcggggccgtcctcgtagacgcccatcggcgcatcaccgacccggagagggacatccaggactttgtcctcaccgccgaactgagcagacacccgcgcgcgtacaccaacaagcgcctggcccacctgacggtgtattacaagctcatggcccgccgcgcgcaggtcccgtccatcaaggaccggatcccgtacgtgatcgtggcccagacccgcgaggtagaggagacggtcgcgcggctggccgccctccgcgagctagacgccgccgccccaggggacgagcccgcccccccagcggccctgccctccccggccaagcgcccccgggagacgccgtcgcatgccgaccccccgggaggcgcgtccaagccccgcaagctgctggtgtccgagctggcggaggatcccgggtacgccatcgcccggggcgttccgctcaacacggactattacttctcgcacctgctgggggcggcctgcgtgacgttcaaggccctgtttggaaataacgccaagatcaccgagagtctgttaaagaggtttattcccgagacgtggcaccccccggacgacgtggccgcgcggctcagggccgcggggttcgggccggcgggggccggcgctacggcggaggaaactcgtcgaatgttgcatagagcctttgatactctagcatgagccccccgtcgaagctgatgtcccgcatcttgcaataaatgtctgcggccgacacggtcggaatttccgcgtccgctggtttctctgcgttgcgtctgaccacgagcacaaacgtgctctgccacacgtgggcggcgaaccggtagccggggcacgcggtcagcatccgatcgatgagccggtagtgcaggtgggccgacgtgccggggaagatgacgtacagcatgtggcccccgtacgtggggtccgggtaaaaaagaaaccgggggtcgcacgccccccctccgcgcaggatcgtgtgcacgaaaaagagctcgggctggccgagcgtatcggccaggaggtcctggaggggggtgctgtggcggtcggccagcacgaccagggaggccagaaaggtgcggtgctcaaagatcgtattgatctgctgcacgaaggccaggatgagggcctcgcggctgacggtggccagccgcccgtcgcccgcgctgcacgcggggcagcagcccccgatccccaggtagtagcccatgcccgagagggtcaggcagttgtcggccacggtctggtccaggctgaaggggagcgacacgggggtcgtcttcaccaggggcacggagagcgagcgcacgatggcgatctcctcggagggcgtctgggcgagggcggcgaagaagccgcggtagcgacggcgctcgtgcaggcagagctccagcctgcgcgcgtgcgacggcaggctcttgcgggaggcccggcgctccacgccggggttcccggcggcggaaaagcgcgaccgccgccgggtcttgtcgcggccgggcccgggccgggagccggagcgacggggggcgatgtcatacataggtacagagggtgtgctccagggacaggagagagatcgagtgtcgtctgagcagcgcgccggcctcgcggacaaatgtggccagcgcggtgggcttcggcacaaatacctggtacgtcttgaaggtgtagatgagggcccgcagggctatacagacccgcccctcgaactcgttgccgcaggccaacttggccttgtgaagctgcagctcgtcgcgatggtcggcgcgggggtggccaaacaggacccaggggtcgacttccatctccgtgatggcgcacatcggatcgcagaacatgtgcttgaagatggcctcggggcccgcggcccgaagcaggctcacgaaccggcccccgtccccgggctgcgcctcggggtccgcctcgagctggtccacgaccggcactatgcagtcgaagaggctggtgttgttctccgagtagcggacgacggacgccctcaggcgtcgcatggccagccagtaggcccgcaccagcaacagattgcacagcaggcattccccgccggtgcgcccgcggccccggccgtgcttcagcacggtggccatcagcgggcccaggtccaggtcgggctgggcctggggctcggcgaactgcgcaaaacgcggggccgcgtcgcgcatgcgcgccccgcggtgcgcttcccaggactcgctgaccgcggcgcggcgggcgtccgcggcggcgcgcagccggggccccgactcccagacggcgggggtgccggcgagcagcagcaggatcaggtcggcgtacgcccacgtctccggctcacccccctgcgccagcgccccggcggcggcctcgaactccccgttgcgggcggcggcgcgcgtgcagcagctgtctccgcccccgcgcttgccctcggtgcagtcgagcaggcgggcgcagtccttccagttcatcagggcggtggtgagggagggttgcgttcccgagcccccgcccgcccccgcccccgccccgtcatcgcccccggaggccagggtcccgatgagggcccgggttgcggactgcgcgaggaaggaatagttggagtactgcaccttggcggcgcccggggagggcgtcggcctgggttgcttctgggcgtggcgcccgggcaccccgccgtcggtccggaagcagcagtggagaaagaaatgccggtggatgtcgttgatggtcagggcgaagcgcgcgaaggagccgacaagggtcgccttcttggtgcgcaggaagtggtggtccatgacgtagacgaactcgaaggcggccacgaagatgctcgcggcgcagtggggcgcgcccaggcacttggcgcagaggaacgcgtaatcggccacccactggggcgagaggcggtaggcctgcttgtacagctcgatggtgcggcagaccagacaggggcggtccagcgcgaaggtgtcgacggacgccgcggcgaagggccccgtgtccaagagtccctctgccgtggggtctgcgggcgggccgcgggcggaccccggcccccgcccccccgaagcctcgcgcgcggccccgcgcggccgcgggggggcgggcgcgacgtcgctctccacgtcctcgtcgagcgcgctcgcgggcggcacgcctaccacgtgacaggccgccaggagctcggcgcacagggcctcgttaagagccagaaggtcgggatcgaaggccacatacggacgctcgaacgcgccctccttccagctgctgcccggcgactcttcgcgcacggcggcgctcgacggcacccccggggcggacgtcgccatggccggtcgagcggggcgcacgcgtccgcgaacgttacgggacgcgatccccgactgcgcgctgcggtcccagaccctggaaagtctagacgcgcgctacgtctcgcgagacggcgcgggggacgcggccgtctggttcgaggacatgacccccgccgaactagaggttatattcccgaccacggacgccaagctgaactacctctcgcggacgcagcggctggcctccctcctgacgtacgccgggcctataaaagcgcccgacggccccgccgccccacatacgcaggacaccgcgtgcgtgcacggcgagctgctcgcccgaaagcgcgaacggttcgcggcggtcattaaccggttcctggacctgcaccagatcctgcggggctgacgcgcgcttcggcggggcaccggcaccgggaccgacttgttttacataacagtagggggtgggggaacgcgcacccttgcccggtcgcgatggcggggatggggaagccctacggcggccgcccgggggacgcgttcgagggtctcgttcagcgcatcaggctcattgttcccgccacgctgcgcggcgggggtggggagtcgggcccctactcgccatccaacccgccctcgagatgtgccttccagttccacggccaggatgggtccgacgaggccttcccgatcgagtacgtcctgcggctcatgaacgactgggccgatgtgccctgcaacccctacctgcgcgtgcagaacaccggcgtttcggtgctgtttcaggggttttttaaccggccccacggcgccccggggggcgcgatcacggcggagcagaccaacgtgattctgcactccaccgagacgacgggactgtccctcggagacctggacgacgtcaaggggcgcctcggcctggacgcccggccgatgatggccagcatgtggatcagctgctttgtgcgcatgccccgggtgcagctcgcgtttcggttcatgggccccgaggacgccgttcgcacgcggcggatcctgtgtcgcgccgccgagcaggccctcgcccgtcgccgccggtccaggcggtcccaggatgactacggggcggtggtggtggcggcggcgcaccactcttccggagcgcccgggccgggggtcgccgcctcgggcccgccagcgccgcccggacggggaccggcccgtccgtggcatcaggccgtgcagttgttccgggccccgcgtccgggccccccggcgcttctgttgctggcggcggggctgtttctgggggccgctatctggtgggcggttggcgcgcgcctatgaaagggggcgagccaccgtcccgcccgccagtgcatcccagacgcccgcgagccgcacatcccctccgctcccgcctccggcccgattcttacggcgcgacccaaggtcccgatggccgccccgcagtttcaccgccccagcaccattaccgccgacaacgtccgggcgctcggcatgcgcgggctcgtgttggccaccaacaacgctcagttcatcatggataacagctacccgcatccgcacggaacgcagggtgcggtgcgagagtttcttcgcgggcaggccgcggcgctgacggacctcggggtgacccacgccaacaacacgttcgccccgcagcctatgttcgcgggcgacgccgcggccgaatggctgcggccctcgttcggtcttaagcgcacgtattccccctttgtcgttcgcgaccccaagacccccagcaccccgtgagtcctcggcgggtccctccgcggccgtctctcgttgcccccctttcccccttcccgggtggttcaataaaaaacaccaacatacgatattcgcgtttgatacgtttattggggggggtgtagggcccaacgatcggcgattaacaacaccaaacaatcgagcgcgtctaacccagtaacatgcgcacgtgatgtaggctggtcagcacggcgttgctgcgctgaaacagcgccctgcgggtccgctgcagctgttgttgtatgcggcggcatgcgcggatcaaaaccgccagggcgctacgaccggtgcttcgtacgtagcgtcgcgacaagacggcatttgcctgtacgggcaaggggccaaattgcgagtgtggtgactggaggtggtcggcggccaatgggccgggtggttcgtcggcggggggcaagtgcggttccggtgggagggggtcgagcgcctcggtatcatccgagtccgagaaacgcagggagtctgcgtcggagtgttcatcatcggaggagatgtgcagcgtctgaagcagcgatgcgggtgggggcgcggagtcgacgtgaagcgcgagagaggaagcccacgaagtcacagcggacactgggaggtgggtgtttgtatgtgtgggagactcgggcgtcgggaccgagtctcggctctggggtgtaagcgtccgagttacgggcggcaggggcggctggggcaggggcggctggggcaggggcggctggggcaggggcggctggggcaggggcggctggggcaggggcggctggggcaggggcggctggggcaggggcggctggggcaggggcggctggggcaggggcggctggggcaggggcggctggggcaccgagcgcgcgcggatgcgcgtccgcgcggcgggtttggtcgcgggtgactggggtggggggcggcgggcaaccgggcctccgggcacgacccaaccgcacaaaggctcgctcggggcaaccgggcctggggccaaaggcggggggctggtctggacggcggaggtcgggggggcaaggcccggagaaggcggcactgccgccgctgcggcggaaaccgcggccgcgtggtcggctgggtcccggggagaggggagggagttcaacgaggccgagagcgaggcgaccgcggggcgcgtgaggcgccggggtgggccggccgcggggccccgggggggtgtcggcgagggacccgctgttgtctggcggcggccgcggcggcggtcgcccccggggacgaccgctccttcggcgggcggaggcgggatgggcgcgagcgtgggggcgggaaaggccccgcgagccgaggcggggccgggcggaaggggcaaagcagaaacccaagccgggggcgcggactccggggtgggcggctggtcgggaggacgcgcggaagcggcgaccggggcgaccggggcggggagtgccggcggacgccacccctcggggggggcggaggcccggggcgcgcgcgatttggcacgcgtccggcgggacctgcgcacgcgcggcacggcggcggagaaagcggcggcagagccggaaaaggccgggggaggaagcgcggcatccgcggggggactcggtgtgggtggcgagggccgtgggtcgtcgcgaggggccacgggcacgcgccccgtgttttgttgaggcgggacactcggtcgtgtttcgcgagccgtagctgccggcccgatgggccgcggtgcgtactgggacgtggggacggactgatcggtggcgggggggggaagaagggccggggccggattgggcgtggggccgccggcgtcgtcggacgccagctcctccaggccgtggatccaggcccacatgcgaggggggacgggctcgccggtggtggcgtcggtgaggagagtgggggcgaggacccccgggtccgcctgccgtgcggggggggcagcggggtcctcgggacccgatccgccatccccccccgcaaggtcccgcgggtcgcgggcggcggtcggggcagagggacctgcctcgtcggcgagggggcgctggtaaaccgggtgtcccgggaacagctcccccgtcaggagggaggcgtcgaagggccgcccgaggatggcccgcgcgaagaaggggtccgcgtcggcggcgctcgccgcgagaacgtcccccgcggtagccacaaacggaagctcctcggtggcctcgctgcccacaaaccgcacgtcaggggggccggggggctccggggcttcccacaagaccgcgaccggggtcatggagatgtccacgaggaccaggcacgggggcccgtcggcgagagggcgctcggcgatgagcgccgacaggcgcgggagctgcgccgccagacacgcgttttcgatcgggttgagatcggtgtggaggaggccgacggcccacgtctcgatgtcggacgacacgacgtcgcgcagggcggcgtccggcccgccggggcgcgagtcgaagagcgtcaggcacagttccagttccgactcgcgggagaaggccgtggtgttgcggagcgccaccacgacgggcgcgccgaggagcaccgcggccagaaccaggtccatggccgtaacgcgcgcggcgggggtgcggtgggtcgcggcggccagcacggccacgtgctggcccgtgggtcggtagagggcgtggggggcctcggggagggacgccttgcgcccccccgccgggccgagcgtctggccagactccaggcgtgcggccaggagggcgtcgaagctgtcgtactcggtgtagtcgtcgggaaacatgcaggtccacagcgcggccaaagcggcgctcggcagacacatgcgcccgaggacgctcaccgccgccagggcctgggccggactgagcttcccgagcgccgggacgtcccggcgctgggtcccgagctccaaggccgagcgccagggcgccagcgggtcggtttcggacagcttgccccggcgccagtcggccagccgcgtgccgaacaggaggccccgggtcggggggcctccgtccaaaaacgtcggcaacacgcggatgcgggcgtcgggatgcggggtcaggcgctggacgaacagcatggactccgctgcgtcctcgaacgcgcgttcgagggtgaggtgcatgtactcgtgctggcgaacgaggtccaggcgccagaagttgtagatgtgttccggaacgccggccaccagcgcgaccagcacgtcgttctcgttgaaggcgacgcagtggcgctgggacccccgggggcccggcggcggacgcggcgccgccgctccggacgcccagcccagctgggcccagcgacacccaaactcgcgcgtgagggtggtggcgacgagggcgacgtacagctcggccgccgcgtccatcgaggcgccccacgtcgcctggcgatggcgcacgaagcgaccgaacagctgaaagttggcggcctgggcgtcgctgagggccagctggagccggttcacgacggtcagcacgtacatggccgtgaccgtcggggccgattcgaggacgtccgtcggaagcgggggccgcacgcaggccgcctcgggacgcatcagcagcgcgccgagtttgtcggtgacggccgggaagcatagcgcgtactgcagcggcgttccgtccggggccaaaaagctggtggcgaacggcagatccagagcgctgacggcctcacgcagcaccaggggccccgggtctccgccggcgcgcagatacgcctcgccccggcggcgcagcagctgcgggtcgacctcgtggccctcgggggaagaagaggcccgggcgcgggcgtcgagggcgcgaagatcaacgagcaggggcgcgggcgcggactccgcgcccgcgcccgtctggccgccggccctggcgtacgcgctatataagcccatgcggtattggatgagttcccgcgcgccccggaactcctccaccgcccacggggccaggtccgcggccgccgcgtcgaactccgccagcaggcgccccagggcgtcaaagttcatctcccagggcaccctgcgcaccacctcatcccgcagccgggcgcacagggcggtgtgcttggtgacgcgcgcgcccagctcctccacggcctccgcgcgctcggcgcccttggcgcccaggacgccctggtacctggcggaaaggcgctcgtaggccggctgggcccgcagccccgacaccgtgttggtggtgtcctgcagggcgcgcagctgctcgtgcatggcgcggaacccctcgggggacttccaggcgcccccccggacgcggccaaagcgaccccagacctcgtcccactccgcctcggcctcctccagggacctccgcagggcgtcgacgcggcgccgagtatcaaagagcgcccccaggcggccggcgtgccgcgccagggggccggggccgtcgccgcgggcggcgcttagcgggtgcgtctcgaaggtgcgctgggcgtgctctagccagataaccgcgggcacgtcgagctcgcgcgttttctcggtctgatccaacagaacctcgacctggtcggcgatctccgccaccgagcgcgcctggtcgagcgtcttggccacggtcgccgggacggcgaccaccttcagcatggtcttgaggttggccaggccctcggcctcgatctgggcccggcgctcgcgcgcggccagcgcctcccgcaggcccgccatgacccgctcggtggcctccgcgcgctgctgtttggcgcgcaccactgcgtccttggtctcggccgtgtcctgccgggtcacgaaggcgacatactcggcgtacgccgtgttcttcacggggctctggtccacgcgctccaacgccgccgcgcacgcgaccagcgcgtcctcgctgggacacggcagggtgaccccggtccggaccagctccgcggtggcctccgggtcattccgggccgcggatatctgctccgcggcggccgccaggtccaggggcacgccgccgagcgcccggtgcacgtcggcccggatggcgtccaggcgatcgcggagctccacgtagtcggcgtagccatgttggaagaacggcacgtaccggcgcaggccgggcacgctcgtcatgtcgtccgccaggcgccccacggcctcgtggtagtcgataaacccgtcgcccgcctgggccatttccaggagcccctccgcgatgcgcagcagccgcgccaggggctcggcgtcgacccgaaacatgtcggcgtaggtttcggcggcggcgtggaacgccgcgctccagccgaggcggtggatggcggcgagcggggggagcatggggtggcgctggttctcgggggtgtaggggttaaacgcgaaggccgtatccagggcgagggtgaccgcctcggcgttggccgcgagcgcctgctcggcgcgcttgcggaagtcccgggggttgtagccgtgcgtgcccgccagcgcctgcaggcggcgcagctcgaccacgtcgaactcggcgcggttctcgacgcggtccagcgccgcctcgacgccggcggcccagcgctcgctgctgccccgggcgcgctgggccgccatcttcgccgtcaggtcggcgacggcggcctcaagttcgtcggcgcggcgtcgcgtggcgccgatgaccttgcccagctcctgcagggcgcgcccgctgggggaatggtccccggccgtcccttcggcgtgcagcaggcccccgaacccagcctcgtgccccgcgaggctttcccgagcagcggtcgtcgcgcgggccgcggcatcgatgagggcggcatggtccccctccggctgggcgcaggcccggcgcgcctggactaccaggtcggcggccgccgaccccagggtcgtgagctcgtcgatggccccccgcgcctccagggccagccgagtcgcctttacataccccgcggcgctatcggccagcaccgcgaggaaggacaggggcgaggccgggtcgcgggcggccgcgcccagggccgacaccgcgtccgccagggcgccatgcgcccgcacggccgcgtccaccgtcgccgcgggacttgccgtcgcgacggcggcgctcccggcgttgatggcgtttgacacggctttggcgattgtgggggcgtgatcggaaaagaactgcacgaggaccggcgtctcgggggcgtcggcgaacagggtcttcagcaccaccacgaaggcgggatgcaggccggccagagccgtcgcggtatccggggtcgggtgttccagggcctcccggtactgccccagcagcccccacaggtccgcccgcagcgccgccgtgacttccgggggggggccccggacggcatcggccaggtcggtccaccccgcgggcagggaggcccgcagggtcgccagcacggccggacacgcctttagccccacaaagtccgggaggggccgcaggaccccttggagtttgtgcaggaacttctcccgggcgtcgtgggccaccttggcgcgctcccgcgcgtcgttgagcatcgcctccagggcgtgggcgcgctcccgaagccgggagcgcgcctccggagcgagctccgccgtcatcttggccgcctccatggccctcgcctgccgcagcgcgtcttcggccatgcgcgtggcctcgggggacagcccgcccccgtcgacgtacggcgcggggccggtcgccgggacgaaggccgcgtcgctgtccagctgctgcgcgagcgccgcgtcgagggcgtcgaagcgctgcagttcggccagccccgagctgcgccgcgcctgctggtcgttgatgccgtggatgctgcgcgccagctcttccaggggcttgcgttcgatgagcccctgggtcgcggcgtcggtcaggaccgagagccaggccgccaggtcctcgggggcatctagggtctggccccgctggagcaggtcccgcagcaggatggcctgggggctggtggcgagggggggcgggggggggagcgcggcgcgctgagcgacgtcccgcgtgtgttggtcaaaggccggtagcgattccagcaactggaccatgggcacgaccgcggccgaggccacgtgaaaccgacagtcgtggctgtcgctggcctgcagggccttcgcgctgtatacggctccccggtggaagtactccttgaccgcgctctcgatcgcccggcgggcctggatccgcacgtcctccagccgcgcctggatggcctcggggcccagggcgggcgggcacggggccctgccgccggcgcccggggcggcgggcacgggcatcacggtcaggggcccggcgcgctgcgagaccgagtcgaccccgcgggcgagggcgtctaaggcctcgcgcatctcgcgggcctccgcctcgacccgcatctcttcgccccgggcaaactgggccagcgcctggatccgatggagaagcggctccgggtgcgtcggggtggcgggggcgaacagggtgttcgggtgggcgcgcgagcgctccaggagccactctccgaggcgtgcgtacagattggccggcggggcggcgcgcagctgcagatccaggtccgcgaggtccccgtaaaaggcgtccgtctcccgaataacgtccctggcgaccaggaccagcttagcgagggccaggcgcccgatctgcgaattttcgtccagcacgtgctggatgaggggccggtgggcggccacgtccgccaggctcatgcgcgtggacgccaggaagtccccgacggccgttttgcggggcagcatgcgcagggtgaagtccagcagggccgcggccgggccggccaccccggcctgcgtatgcgtgcgggccccgttctcgatcaaaaaggcgaggacgcgctcaaagaagaagatgacgcagagctccaacagccccgggtgcgccgggtacggcgaccgcagggcgttgatggtgagctgcgaacacgcggccacctcgcgggccagggcggcatcgcgcgccgcgagccggaccgccgtggcggccacattggggtggacctcgaacagctgcgccaggtcggcgccggggggctccggggggcggcgggcccccagcgtctcgagcacggacggcgacgacgggctcgcgggcccgtcgtcgccgccgccctgcccggactgcgggggggtatccggtgcgggagggaccgtggcggctatgggcgtcggggaggaggcggggacctcggcggcgacgggggccttcttcttgggcgcggacttcttcttggccttggcgggcggggccttgggggcgggcctctcgcccgaggtcagatcctccacgctggacggtggggtccaggtgggccggcggcgcttgggcaagccggtagaatagcgcgcccggtggcgacccaccggcactgcccccacctccaggacccgcaggtcctcggcttcttcggccgcgtccccggcgggtgtctgcgggggcggggcggcgtgcggtggacccgaggccgcggcgtccggggccgagggcttcgcgggcggggtcccctccagggctgctgcccacacatcatcgggggggcggtttgggtgccccgcctgcggtgtgtcgggtgggcccgaggccccccggggggcctcggggggccggtcggccccaggggtctggacgtgggtgggcgcggggagcgcggggacgaccgggcccgagccttctccgtcccccctggggaccacaccgacaaagagcgccccgagccccccgatctcgccccgcagggggtgggtgatggccacgcgccgctcgacgaacggttcgtcctgcaggtaagtctcgctggccccgtagaggtgcagggccgcggcggtcaggtccgccggcgccacggcccccgggccggagggcacaaaaaacaccatggcgcccgcccaccgcaccttggggcggtcgtgggcgtaatacgtcaggtacgggtacacgtcgcccgcccgcaccttggcgataaacgcgggcgttcccgcgggcaggccgtgcgggtcaaacagataggccgtgtcgccgtcccggtagagccccatgcccagggggccgatggtcaggagcgtgtaggacagcggccgcatggcccaggggccggcgaagaacgtgtgcgcggggcattgcgtctccagcagccccgccgtgggctccccgaagaagcccacctcgccgtacacccgcgaaaacacgcaacgcaggccgccgcgcgccgccgggtactccaggaagttggggagctcgataatggaacacatgcgcggcggcccggagcccgcggccgcgcgcgtccactcgcccccctccaccagacatccctcgatggcctccgcggacagcacgtcgcggggccccacgtcgaaaagaagactgagaaacgacagggacgagcgcatgcacgataccgacccccccggctccagatcggtcgcgaactggttccgaacaccggtgaccacgatatcgcgatccccctggcgcttcatcgtggggtgaggtagcgcggccggaatcatgtgtgccgcgcccgccacgagcggggcctgtttatgggccgggcgtcccgatgagtactgttgtttccgccgcccgaacccccccgcccatcaaccgcctgttcgtccccctaaccacacacccggtatcgcgtgtgtgtggtttcccgggaagacacatcccaccccatgaagttttgccctttttttccgtcccgcactacgccacctttccaccccccccccaaaaaaacaacaaccaactcccagatggatgggtgcgataataaagctttattattgtttaaccaaaggcgagtcctacgggtgtaccggtggtgtctcctgcggcgtcatctcgtcgtcctccacgggggtgttgggccaagggaccgtctcgcggcccgccgggcgcgtcgacggcgcgcgggcctgcgtgtcctgtgggccgggtgtcgtgggttcgggggtgctaccgccggcatcttgggcctccaggtccccgggggcccccgggccggcggaaggccgaaacgccgaggcgcgaaacacgccgtcggtgacctgcaggagctcgtttattaatagccagtccatgctcagcgtagcggccagcccctggggagacaggtccacggagtccggaaccaccgtcggctgacccaggggccccaggctgtagtccccccaggcccccaggtcatgacggttcgtgagcacgacgaggtctgcggccgggctggggggcgcgtcctcggtcgcgtgggccatcacctcctgaatggctgcggtgcgctgatcggccgagctggcgaagggcgccacgaccagcgcgcgctccgtctgcaggcccttccacgtgtcgtggagttcctgaacgaactcggccacccgctcggggcccgtggccgcgcgtgcggcctgatagccggccgagaggcgccgccagcgcgccaggaactgactcatgtaacagaacccggggacctggtcccccgacatcaactttgacgccctggcgtggatgcccgacacgatggccaggaacccgtggatttcccgccgcacgacggccagcacgttaccctcgtgcgagacctgggccgccagctcgtcgcataccccgaggtgcgccgtcgtctcggtgacgacggaccgcagccccgcgagggacgcgaccagcgcgcgcttggcgtcgtgatacatgccgcagtactggctcaccgcgtcgcccatggcctcggggcgccagggccccaggcgctcgtgggcgtctgcgaccacggcgtacaggcggtgcccgtcgctctcgaaccggcactcaaagaaggcggcgagcgtgcgcatgtgcagccgcagcagcacgatcgcgtcctccagctggcggaccagggggtcggcgcgctcggcgagctcctgcagcaccccccgggccgccagggcgtacatgctgatcagcagcaggctgctgcccacctcgggaggctgggggggaggcagctggaccgcgggccgcagctgctcgacggcccccctggcgatcacgtacagctcgcgcagcagctgctcgatgttgtcggccatctgcatcgtgggcccgacgccggcccgggtggccggttcgaggagggtgatcagcgcgcccaattttgtgcggtgcccctcgacggtggggagatagcccaggccgaagtcgcgcgcccaggccagcacccgcagggcaaactcgatggggcggggcaggtaggcagcgttgcacgtggccctcagcgcgtccccgaccaccagggccagcacgtaagggacgaaccccgggtcggcgaggacgttggggtggatgccctccagggccgggaagcggatcttggtggccgcggccaggtgaaccgagggggcgtggctaggcggcccgacggggagcagcgcggacagcggcgtggccggggtggtgggggtcaggtcccagtgggtctggccgtacacgtcgagccagatgagcgccgtctcgcgcaggaggctgggctggccggcgctgaagcggcgctcggccgtctcaaactcccccacgagcgtgcgccgcaggctcgccaggtgttccgtcggcacggccgggcccatgatgcgcgccagcgtctggctgaggacgccgcccgacaggccgaccgcctcacagagccgcccgtgcgtgtgctcgctggcgccctggatccgccggaacgttttcacgtagccggcgtagtgcccgtactcccgcgcgagcccgaacacgttcgcccccgcaagggcaatgcacccaaagagctgctggatctcgctgagcccgtggccggggggcgtccgcgcgggcacccccgccaccaaaaacccctccagggccgatatgtactgggtgcagtgcgcgggcgtgaaccccgcgtcggtaagcgtgttgatcaccacggagggcgagttgctgttctggaccaaagcccacgtctgctgcagcagcgcgaggagccgttgctgggccccggcggagggcggctcccctagctgcagcaggccggtgacggccggacggaagatggccagcgccgacgcactcagaaacggcacgtcggggtcgaagacggccgcgtccgtccgcacgcgcgccatcagcgtccccgggggcgcgcacgccgaccgcgggctgacgcggcttagggcggtcgacacgcgcacctcctcgcgactgcgaaccattttggtggcctcgaggggcgggatcatgatagccgggtcgatctcccgcaccgtgtgctgaaactgggccagcagcggcggcgggaccaccgcgccccgatcgggggtcgtcaggtactcgtccaccagcgccagcgtaaacagggcccgcgtgaggggggtcagggcggcgtcgtcgatgcgctgtaggtgcgccgagaacagcgtcacccaattgctgaccagggccaagaaccggagaccctcttgcacgatcggggacgggaagagcaggctgtacgccggggtggtcaggttggcgccgggttgccccaggggaaccggggacatcttaagcgacatctccccgagggcctccagggaggtccgcgggttcatggccaggcagctctgggtgacggtccgccagcggtcgatccactccacggcacactggcggacgcgcaccggccccagggccgccgtggtgcgcagcccggcggcctccagcgcgtgggtcgtgtcggagccggtgatcgccaggaccgtgtccttgatgacgtccatctcccggaaggccgcctcgggggtctcggggagcgccaccgccatgcggtgcaccagcagcccggggaggttctcggccaagagcgccgtctccggaagcccgtgggcccggtgcaaggcgcacagttgctccaggagcgggtgccagcacgcccgcgcctccgccgggccgaccgccgcgcccgacaacagaaacgccgccgtggcggcgcgcagtttggccgcggacagaaacgccggctcgtccgcgctgcccgccggctcgctcgagggggagggcggccggcggaggttggtcaggctccccaacaggacctgcaacggtccgtttgggggtggagcggacgggggggtcatgccggcgggcgccgggacctggagcgcgctgtccgacatggcgaccggcgtgcgcgctcggcgacgcggcgcggagaccgcgggcccaaacgggaatgactgccgccgccctatacggaggggctaagtatcgcccggggacccttcgaaaccccgggcgtgtcgcaagtacgccgcgaaggcgcggcgtgttatacggcgcgttatgtcccggcattccgttcgtgggttcgggcccgggtgctgtcgggtgggagtgtgtgtgggggggggcggcgcgacggcggcccggaccaagtgtatcgcggccgttccgtggggcggcccaacaggccctttaaacatttgcgtatgcaccggcccagccagtcggacaccggaacccaccagaggcggaagccgccttcgcccgtgagggtgcgtgtgttttctggtggcgtgtttttcctttccgccctcctccctccccacctccaccacccccccccacaactcgcccgttggcgatcggcgggaaaaccatgaaaaccaagccactcccgacagccccgatggcgtgggccgagagtgccgtggaaaccaccaccagcccgcgcgagctcgcgggccacgccccgctccggcgcgtcctgcgcccgcccatcgctcgccgcgacggcccggtgcttttgggggacagggcccccaggaggacggccagtacgatgtggctgctggggatcgaccccgcggagtcgtctccgggaacgcgcgctacccgagacgataccgagcaggccgtggacaagatcctcaggggagcccggcgcgcgggagggctgaccgtccccggcgccccccgctatcacctgacccgccaggtaaccctgacggatctctgccaaccaaacgcggagcgggccggggcgctccttttggccctgcggcaccccaccgacctcccccacctggcccgccatcgggctccgcccggccggcagaccgagcgactggccgaggcctggggccagctcctggaggcctccgccctggggtccgggcgggccgagagcggctgcgcgcgcgcgggccttgtgtcgtttaactttctggtggccgcgtgcgccgccgcctacgatgcgcgcgacgccgccgaggcggtccgggcccacatcacgaccaactacggcgggacgcgggccggggcgcggctggaccggttttccgaatgcctgcgcgccatggtccacacgcacgtgtttccccacgaggtcatgcggtttttcggggggctagtgtcgtgggtcacacaggacgagctggctagcgtcaccgccgtctgcagcggaccccaggaggccacacacaccggccacccgggcaggccccgttcggccgttaccatcccggcctgcgccttcgtggacctggacgccgagctgtgcctggggggccctggggcggcgttcctgtacttggtcttcacctaccgacagtgccgggaccaagagctctgttgcgtgtacgtggtcaagagccagctccccccgcgcggactggaggcggccctcgagcggctgttcgggcgcctccggataaccaacacgattcacggggccgaggacatgacgccccctcccccgaaccgaaacgttgactttccgctcgccgtcctggccgcgagctcgcaatccccgcggtgctcggcgagccaagtcacgaacccccagtttgtcgacaggctgtaccgctggcagccggatctgcgggggcgccctaccgcacgcacctgcacatacgccgccttcgcagagctgggtgtcatgccagacgacagcccccgctgtctgcaccgcaccgagcggtttggggcggtcggcgttccggttgtcatcctggagggcgtggtgtggcgccccggcgggtggcgggcctgcgcgtgatcgtctattgacgacggccgcccaacccgagcgaccttcccctcccacttccccccccctacacaccaactccgccctcgccgtcttggccgtgcgcggccccgtgcgtccgtctcaataaagccaggttaaatccgtgacgtggtgtgtttggcgtgtgtctctgaaatggcggaaaccgacatgcaaatgggattcatggacacgttacacccccctgactcaggagataggcatatcctccttagattgactcagcacacgatcgcaccccacccctgtgtgccggggataaaagccaacgcgggcggtctgggttaccacaacaggtgggtgcttcggggacttgacggtcgccactctcctgcgagccctcacgtcttcgcccaccgattcctgttgcgttcctgtcggccggtgctgtcctgtcgacagattgttggcgactgcccgggtgattcgtcggccggtgcgtcctttcggtcgtaccgcccaccccgcctcccacgggcccgccgctgtttccgttcatcgcgtccgagccaccgtcaccttggttccaatggccaaccgccctgccgcatccgccctcgccggagcgcggtctccgtccgaacgacaggaaccccgggagcccgaggtcgccccccctggcggcgaccacgtgttttgcaggaaagtcagcggcgtgatggtgctttccagcgatccccccggccccgcggcctaccgcattagcgacagcagctttgttcaatgcggctccaactgcagtatgataatcgacggagacgtggcgcgcggtcatttgcgtgacctcgagggcgctacgtccaccggcgccttcgtcgcgatctcaaacgtcgcagccggcggggatggccgaaccgccgtcgtggcgctcggcggaacctcgggcccgtccgcgactacatccgtggggacccagacgtccggggagttcctccacgggaacccaaggacccccgaaccccaaggaccccaggctgtccccccgccccctcctcccccctttccatggggccacgagtgctgcgcccgtcgcgatgccaggggcggcgccgagaaggacgtcggggccgcggagtcatggtcagacggcccgtcgtccgactccgaaacggaggactcggactcctcggacgaggatacgggttcggagacgctgtctcgatcctcttcgatctgggccgcaggggcgactgacgacgatgacagcgactccgactcgcggtcggacgactccgtgcagcccgacgttgtcgttcgtcgcagatggagcgacggccccgcccccgtggcctttcccaagccccggcgccccggcgactcccccggaaaccccggcctgggcgccggcaccgggccgggctccgcgacggacccgcgcgcgtcggccgactccgattccgcggcccacgccgccgcaccccaggcggacgtggcgccggttctggacagccagcccactgtgggaacggaccccggctacccagtccccctagaactcacgcccgagaacgcggaggcggtggcgcggtttctgggggacgccgtcgaccgcgagcccgcgctcatgctggagtacttctgtcggtgcgcccgcgaggagagcaagcgcgtgcccccacgaaccttcggcagcgccccccgcctcacggaggacgactttgggctcctgaactacgcgctcgctgagatgcgacgcctgtgcctggaccttcccccggtcccccccaacgcatacacgccctatcatctgagggagtatgcgacgcggctggttaacgggttcaaacccctggtgcggcggtccgcccgcctgtatcgcatcctgggggttctggtccacctgcgcatccgtacccgggaggcctcctttgaggaatggatgcgctccaaggaggtggacctggacttcgggctgacggaaaggcttcgcgaacacgaggcccagctaatgatcctggcccaggccctgaacccctacgactgtctgatccacagcaccccgaacacgctcgtcgagcgggggctgcagtcggcgctgaagtacgaagagttttacctcaagcgcttcggcgggcactacatggagtccgtcttccagatgtacacccgcatcgccgggtttctggcgtgccgggcgacccgcggcatgcgccacatcgccctggggcgacaggggtcgtggtgggaaatgttcaagttctttttccaccgcctctacgaccaccagatcgtgccgtccacccccgccatgctgaacctcggaacccgcaactactacacgtccagctgctacctggtaaacccccaggccaccactaaccaggccaccctccgggccatcaccggcaacgtgagcgccatcctcgcccgcaacgggggcatcgggctgtgcatgcaggcgttcaacgacgccagccccggcaccgccagcatcatgccggccctgaaggtcctcgactccctggtggcggcgcacaacaaacagagcacgcgccccaccggggcgtgcgtgtacctggaaccctggcacagcgacgttcgggccgtgctcagaatgaagggcgtcctcgccggcgaggaggcccagcgctgcgacaacatcttcagcgccctctggatgccggacctgttcttcaagcgcctgatccgccacctcgacggcgagaaaaacgtcacctggtccctgttcgaccgggacaccagcatgtcgctcgccgactttcacggcgaggagttcgagaagctgtacgagcacctcgaggccatggggttcggcgaaacgatccccatccaggacctggcgtacgccatcgtgcgcagcgcggccaccaccggaagccccttcatcatgtttaaggacgcggtaaaccgccactacatctacgacacgcaaggggcggccatcgccggctccaacctctgcaccgagatcgtccacccggcctccaagcgatccagtggggtctgcaacctgggaagcgtgaatctggcccgatgcgtctccaggcagacgtttgactttgggcggctccgcgacgccgtgcaggcgtgcgtgctgatggtgaacatcatgatcgacagcacgctacaacccacgccccagtgcacccgcggcaacgacaacctgcggtccatgggcattggcatgcagggcctgcacacggcgtgcctgaagatgggcctggatctggagtcggccgagttccgggacctgaacacacacatcgccgaggtgatgctgctcgcggccatgaagaccagtaacgcgctgtgcgttcgcggggcgcgtcccttcagccactttaagcgcagcatgtaccgggccggccgctttcactgggagcgcttttcgaacgccagcccgcggtacgagggcgagtgggagatgctacgccagagcatgatgaaacacggcctgcgcaacagccagttcatcgcgctcatgcccaccgccgcctcggcccagatctcggacgtcagcgagggctttgcccccctgttcaccaacctgttcagcaaggtgaccagggacggcgagacgctgcgccccaacacgctcttgctgaaggaactcgagcgcacgttcggcgggaagcggctcctggacgcgatggacgggctcgaggccaagcagtggtctgtggcccaggccctgccttgcctggaccccgcccaccccctccggcggttcaagacggccttcgactacgaccaggaactgctgatcgacctgtgtgcagaccgcgccccctatgttgatcacagccaatccatgactctgtatgtcacagagaaggcggacgggacgctccccgcctccaccctggtccgccttctcgtccacgcatataagcgcggcctgaagacggggatgtactactgcaaggttcgcaaggcgaccaacagcggggtgttcgccggcgacgacaacatcgtctgcacaagctgcgcgctgtaagcaacagcgctccgatcggggtcaggcgtcgctctcggtcccgcatatcgccatggatcccgccgtctcccccgcgagcaccgaccccctagatacccacgcgtcgggggccggggcggccccgattccggtgtgccccacccccgagcggtacttctacacctcccagtgccccgacatcaaccaccttcgctccctcagcatcctgaaccgctggctggagaccgagctcgtgttcgtgggggacgaggaggacgtctccaagctctccgagggcgagctcggcttctaccgctttctgtttgccttcctgtcggccgcggacgacctggtgacggaaaacctgggcggcctctccggcctcttcgaacagaaggacattcttcactactacgtggagcaggaatgcatcgaggtcgtccactcgcgcgtctacaacatcatccagctggtgctctttcacaacaacgaccaggcgcgccgcgcctatgtggcccgcaccatcaaccacccggccattcgcgtcaaggtggactggctggaggcgcgggtgcgggaatgcgactcgatcccggagaagttcatcctcatgatcctcatcgagggcgtcttttttgccgcctcgttcgccgccatcgcgtacctgcgcaccaacaacctcctgcgggtcacctgccagtcgaacgacctcatcagccgcgacgaggccgtgcatacgacagcctcgtgctacatctacaacaactacctcgggggccacgccaagcccgaggcggcgcgcgtgtaccggctgtttcgggaggcggtggatatcgagatcgggttcatccgatcccaggccccgacggacagctctatcctgagtccgggggccctggcggccatcgagaactacgtgcgattcagcgcggatcgcctgctgggcctgatccatatgcagcccctgtattccgcccccgcccccgacgccagctttcccctcagcctcatgtccaccgacaaacacaccaacttcttcgagtgccgcagcacctcgtacgccggggccgtcgtcaacgatctgtgagggtctgggcgcccttgtagcgatgtctaaccgaaataaaggggtcgaaacggactgttgggtctccggtgtgattattacgcaggggaggggggtggcggctggggaaagggaaggaacgcccgaaaccagagaaaaggaccaaaagggaaacgcgtccaaccgataaatcaagcgccgaccagaaccccgagatgcataataacgattttattactcttattattaacaggtcgggcatcgggaggggatgggggcgcgcgtttcctccgttccggctactcgtcccagaatttagccaggacgtccttgtaaaacgcgggcgggggcgcgtgggcccacagctgcgccagaaaccggtcggcgatgtccggggcggtgatatgccgagtcacgatggagcgcgctaaatcttcgtcgcggaggtcctgatagatgggcagtctttttagaagagtccagggtccccgctccttggggctgataagcgatatgacgtacttgacgtatctgtgctccaccagctcggcgatggtcatcggatcgggcagccagtccagggcctccggggcgtcgtggatgacgtggcggcgacgtccggcgacatagccgcggtgttccgcgacccgctgcgcgttggggacctgcacgagctcgggcggggtgagtatctccgaggaggacgaccgggcgccgtcgcgcggcccaccggcgacgtccgggggctggaggggggggtcttcttcgtagtcgtcctcgcccgcgatctgttgggccagaatttcggtccacgagatgcgcgtctcgaggccgaccggggccgcggtcagcgtaggcatgctctccagggagcgcgagttggcgcgctcccgccgggccgcccggcgggcctgggatcggctcggggcggtccagtgacactcgcgcagcacgtcctcgacggacgcgtaggtgttattggggtgcaggtctgtgtggcagcggacgaacagcgccaggaactgcgggtaactcatcttgaagtactgcagcaggtcgcggcagtgaatcgtcggaatgtagccggtgctgatgtccaacacgatatcgcagcccatcagcaggagatcggtatccgtggtatgcacgtacgcgaccgtgttggtatgatagaggttcgcgcaggcgtcgtcggcctccagctgacccgagttgatgtaggcgtaccccagcgcccgcagaacgcggatacagaacaggtgagccaggcgcagggccggcttcgagggcgcgcccgagggggccgccgggcctgggccggcggcccgcgttccccggtcccccggggcgaaggcgtgcccgcggcggcgcatgttggaaaaggcgaaactgggcctggagtcggtgatgggggaaggcggcggcgaggcgtctacgtcactggcctcctcgtccgtgcggcactgggccgtcgtgcgggccaggatcgccttggccccgaacacaaccggctcggtacactcgaccccgcgatcggtcacgaagatggggaacagggacttttgggtaaacacccgtaacatactacagagacagtgtagcgtgattgcctcgcggtcgtaacttgggtagcggcgctgatatttaaccaccagggtatacatgacattccacaggtccacggcgatgggggtaaagtagccctccggggcccggaggccccggcgcttcaccagatggtgagtctgggcaaacttcatcatgccaaacagacccattccggcacgattgtaggtgcggataggtctctctacagagctgtataggtgtgacggtccgggacacccaagcccgccgcccctgtgtacagtggctgcggcgacgaccccgctccaacaagacgctatcccgggaaaggcacgctctttataattcttttttatttcccatctacgtgcggattggtgcaaccgccggcgcgcgccggtgcaggccgaccatctctctcttccccccctccccctcccccgagccctcaaagagggtgtggcctaactagcggaaggcgtatttaaccagactagggcggcgggtccgccgtagtccttggctcgggtagccactgctctgtggctcgggtcccccggcccccctaacccccatccggtccgcgtcatccgccccctccgcctgcgacacaaacggccgcgcctccgggcccggtgacacgacgcgcctcgtctctgcggattgtcccgggagcgtcgcggcatggctcatcttcccggcggtgcggccgccgcccccctttcggaggacgcgatcccgtcgccgcgcgagcggacggaagactggccgccctgccagatagtgctgcagggcgccgagctgaacgggatcctgcaggcctttgcgccgcttcgcacgagccttttggactcgctcctggtcgtgggcgaccgaggcatccttgtacataacgcgattttcggcgagcaggtgtttctgcccctcgaccattcgcagttcagtcgctatcgatggggcggacccaccgcggcgttcctgtctctcgtggaccagaagcgatccctgctgagcgtgtttcgcgccaaccagtaccctgacctgcggcgggtggagctgacggtcacgggccaggccccgtttcgcacgctggtgcagcgcatatggacgaccgcgtccgacggagaggccgtggagcttgccagcgagacgctcatgaaacgcgagttgacgagcttcgcggtactactcccccagggcgaccccgacgtccagctgcgcctcacgaagccccagctcacgaaggtggtgaacgccgtcggggacgagaccgccaaacccaccacgttcgagctcggccccaacggcaagttttccgtgtttaacgcgcgcacctgcgtcacctttgccgcccgcgaggagggcgcgtcgtccagcaccagcgcccaggtccagattctgaccagcgcgctgaagaaggcgggccaagcggccgccaacgccaagacggtctacggggaaaacacacaccgcacattctcggtggtcgtcgacgactgcagcatgcgggcggtcctccggcggctccaggtcggcggggggaccctcaagttcttcctcacggccgacgtccccagcgtgtgtgtcaccgccaccggccccaacgcggtgtcggcggtgtttcttttaaaaccccagcgggtctgcctgaactggctcggccggagcccgggttcctcgaccgggagcttggcgtcccaggactctcgggccggcccgaccgacagccaggactcctcctccgagccggacgcgggcgaccgcggcgccccagaagaagaaggcctcgagggccaggcccgggtaccgcccgcgttcccggaaccgccgggaaccaagcggaggcaccccggggccgaagttgtccccgcggacgacgccaccaagcgcccgaagacgggcgtgcccgccgcccccacgcgagccgagtcgccccccctctccgcgagatacggacccgaggcggcggagggtggtggggacggcggccgctacgcgtgctactttcgcgacctccagaccggcgacgcgagccccagccccctctccgccttccggggtccccaaagacccccatacggctttgggttgccctgacggcaacgggtggtggccgaacgcctcaccgcgcccgggcacgcggggtgcgttgtgttaaaaaaataaataaatggggtagtgtgtcccccccccctccaaccaatatggctgtcgtgtgtggttccgggttgcgcctccgtcctttccaccccccttccccctccttttttgttttgcgtgcgcttataagagcgggcccggggcccttcgcagcttcaccgagagcgccgtcgggccccgggtgcgggatgtgtcgcggggacagccccggggtcgcgggcgggagcggcgaacactgcctcggaggggatgatggggacgacgggcgcccccgcctcgcctgcgtgggtgccatcgctcgggggttcgcgcatctctggctccaggccgccacgctgggcttcgtggggtctgtcgttctgtcgcgcggcccgtatgcggacgccatgtcgggggcgttcgtgatcgggagcaccggcctggggttcctccgcgccccccccgcgttcgcccggccgccgacgcgtgtgtgcgcgtggctgaggctggtcggcgggggagcggccgtggccctgtggagcctcggggaggccggcgcgcctccgggggttccgggcccggcgacccagtgcctggcgctcggggccgcctacgcggcgctgctggtgctggccgacgacgtccatccccttttcctcctcgccccgcggcccctgtttgtcggcaccctgggggttgtcgtcggcgggctgacgataggcggcagtgcgcgctactggtggatcgacccccgcgccgccgcggccctgacggcggcggtggtggcgggcctcgggacaaccgccgccggggacagcttttccaaggcctgtccccgccaccgccgcttttgcgtcgtctccgcggtcgagtctcccccgccccgatacgccccggaggacgccgagcggccaacagaccacggacccctgttaccgtcgacgcaccaccagcgatctccgcgggtctgcggcgacggggccgcacggcccgaaaacatctgggttcccgtggtgacctttgcgggcgcgctcgcgctggccgcctgcgccgcgcgagggtctgacgcggctccgtcaggcccggtcctgccgctgtggccccaggtgtttgtcgggggccacgcggcggcgggcctgacggagctgtgtcagaccctcgcgccccgggacctcacggacccgctgctgtttgcgtacgtcggattccaggtcgtgaaccacgggctgatgtttgtggtccccgacatcgccgtatacgcgatgctggggggcgccgtgtggatctcgctgacgcaggtgcttgggctccggcgccgccttcacaaggacccagacgccgggccctgggcggccgcgaccctgcggggcctctttttctccgtctacgcattggggtttgcggcgggggtgctggtgcggccgcggatggcggcgagccggcggtcggggtgatcgccatttcaaataaaaggcacgagttccccgaataccaccggcgtgtgatgatttcgccctaccgctccgatccccggggggaggggggaaggaaatgggggcgggggtgccgtggacgggtataaaggccaggggggcaggcgggcccatcactgttagggtgttaggttgggaggtggcacaaaaagcgacactcccgtgttgtagttgtccgcgggaggcggtggtttccggcaaccctcctcgctgcgccgggcgcgcccaccggtccttcgcgggggccggggctcttctggtcatggcccttggacgggtgggcctagccgtgggcctgtggggcctgctgtgggtgggtgtggtcgtggtgctggccaatgcctcccccggacgcacgataacggtgggcccgcgggggaacgcgagcaatgccgccccctccgcgtccccgcggaacgcatccgccccccgaaccacacccacgcccccccaaccccgcaaggcgacgaaaagtaaggcctccaccgccaaaccggccccgccccccaagaccgggcccccgaagacatcctcggagcccgtgcgatgcaaccgccacgacccgctggcccggtacggctcgcgggtgcaaatccgatgccggtttcccaactccacccgcacggagttccgcctccagatctggcgttatgccacggcgacggacgccgagatcggaacggcgcctagcttagaggaggtgatggtaaacgtgtcggccccgcccgggggccaactggtgtatgacagcgcccccaaccgaacggacccgcacgtgatctgggcggagggcgccggcccgggcgccagcccgcggctgtactcggtcgtcgggccgctgggtcggcagcggctcatcatcgaagagctgaccctggagacccagggcatgtactactgggtgtggggccggacggaccgcccgtccgcgtacgggacctgggtgcgcgttcgcgtgttccgccctccgtcgctgaccatccacccccacgcggtgctggagggccagccgtttaaggcgacgtgcacggccgccacctactacccgggcaaccgcgcggagttcgtctggttcgaggacggtcgccgggtgttcgatccggcccagatacacacgcagacgcaggagaaccccgacggcttttccaccgtctccaccgtgacctccgcggccgtcggcggccagggccccccgcgcaccttcacctgccagctgacgtggcaccgcgactccgtgtcgttctctcggcgcaacgccagcggcacggcatcggtgctgccgcggccaaccatcaccatggagtttacgggcgaccatgcggtctgcacggccggctgtgtgcccgagggggtgacgtttgcctggttcctgggggacgactcctcgccggcggagaaggtggccgtcgcgtcccagacatcgtgcgggcgccccggcaccgccacgatccgctccaccctgccggtctcgtacgagcagaccgagtacatctgccggctggcgggatacccggacggaattccggtcctagagcaccacggcagccaccagcccccgccgcgggaccccaccgagcggcaggtgatccgggcggtggagggggcggggatcggagtggctgtccttgtcgcggtggttctggccgggaccgcggtagtgtacctcacccacgcctcctcggtgcgctatcgtcggctgcggtaactccggggccgggcccggccgccggttgtcttcttttccaccccttccgtcccccgtacccaccacaccccaccccacccccccgccgtcccccgggcgttataagccgccgcactcgcttttcccaccggaaaatcctcggcccgatccgaacggcgcacgccgcgtgggctccaaacgcctccggaagagagcgccccgccccgatattcaagcccgcggtggtgctatggctttccgtgcttcgggacccgcctaccagcccctcgcccccgcggcctccccggcgcgggctcgtgttccggccgtggcctggatcggcgtcggagcgatcgtcggggcctttgcgctcgtcgccgcgttggttctcgtaccccctcggtcctcgtggggactctcgccgtgcgacagcggctggcaggaattcaacgcgggatgcgtcgcgtgggaccccacccccgtcgagcacgagcaggcggtcggcggctgcagcgcgccggccacccttatcccccgtgcggccgccaagcacctggccgctctgacacgcgtccaggcggagagatcgtcgggttactggtgggtgaacggagacggcatccggacctgtctgagactcgtcgacagcgtcagtggcatcgacgagttttgcgaggagctcgcgatccgcatatgctactacccacgaagccccggcgggtttgtccgcttcgtaacttcgatacgtaacgccctggggttgccgtgaggcgcgcgtccgacggtcccgcttctcgcctctcttcttcccccaccccacccaccgaccaacgacggcgtttggccaataccctccttttttctttttctcttccccccccccccaaaaaaaacaataaacagctaattgcgtacgacaaaccatgcggaactcgctgttttttttctctgtttgttactttttattgaaacagacatacggggaaaggggccggaaaccgagacggtggggccggcggtcgcatttttttaatggctctggtgtcggccgcgtttgagcttcgtcaacagggcgctgagggcggcgacgttcgtcgggccgtcgttggccagcgcgttggtccgggggcgggcgggcatgggcgacaggcttagtcccgggtccggggcgcgtgtggcccccggaggggagaagagggcagacccgccccagtcgtacaggggattttccgcctcgatgtacggggagtccggggcgtctcccggcagggcggccccgccggcaagacgccggcgagggcagatgttttcgtatacccgaacccaggggatctcctcgtagacgcgccccccatcctcgcccaccgactcgtaaatggaatctgcgtcctcggagggggcgcggggggcgtggctttcggccggccaggcggcggcggcggtggtgtcggcggcgggggtggcgccaagcccgacgcccgcgggcatggcggcgtcatcgtcgggcagcagatacgtgttttccatctggtccggttcggcctccgcgtccggcccccaggtccgcaccgcgtcgtagaccccggcggcctcgcgctgagccgcgagcgggcgcgccgcggctgccggccgctgctcggggggcgcggggttgcggggcgggaggcgcgggggcgccccggccatatgcgtgtaatacgtggccggccggccggcgcagggctcgggaccccggtcggccgcgtcgacgtgcgggggctcggggaggtcctcgcggtggcgcctgaacctccgaggggccgcgggggtcgagtgggggcgagcccgggggagcggcgggggtgcgttgtcgcgccgggtccgttgtatcttgtcccggcagctcccgccgaccgcgccgcggccccccggtgggccggacgccgcgaggcgcaggatggactcgtagtggggcgacggggttccgctccgaagcaggtccggggccagggcggccccgaaccaggacttgatgctgagttccatccgggcccagctcggggcggtcatcgtggggaacaggggggcggcggtcctgcagaagcgctcctggctgtccaccgccgcccgtaggtactcgttgttcaggctgtcggaggcccagacgacatacccggtaagcgtcgcgttaattatatactgggcgtggtggtggactatggatagaacctcgacggtcgagacgatggcgtccacgatcccgtacgtgccgccgctgcgcttgccggtctcccacaggtgggccaggcgcgtcaggtggcccaggacgtcgctgaccgccgcccgcagggccatgcactgcatcgagcccgtggtgccgctgggcccgcggtccaggtggcgcgcaaacgtctccgcgggcgcctccagactcccgctgagcgccacgaaccggcgatcggcggggcccaggcggcgacacacgtacttgtccgccgtccacagcatccacgaggcccaatggtacaacacggagacgtaggccaggagctcgctcagccgcagtgcggtgtccgtgctcggccggctcgggtctgcggggcgcataaagaacatgtactgctggagcctgtgggccgcgtcgcgcaaccccgccaccgcggcggcgtacttggccgcggcggccccgctcttgaacggggcgcgcaccagcagcttcgggagcagggtgggccgcagcagcacgtgcaggctggggtcgcagtcgcccgccgggtcgtcggggatgtccaggccgctgggcacgaccgtctggaggtacttccagtactgcgctaggatggcgcggctcagctggccgcccgacagctccacctcgccgagcgcctgcttggcggccgacgcgtagtgccggatgtagtcgtagtgcgggtcgctggcgagcccgtctacgatcaggctctcggggacggtgttatggtgccgcgccgccagccggacgctgcgatcggcgccggtcagaaacgccggctgcaggtcgtcggcgcgctgccgcaggacgcccacggccgcgctgaggagcccctccggggtggggagcagacacccggcgaagatgcgccgctcggggacgcccgcgttggcgccgcggatgaggttggccggcgtcaggcaccgcgccagccgcagggagctcgcgccgcgcgcccggcgttgcatggcggagaccgttcggtcgggggccccgccggtcggaggtatgccgcgtcccgggatatagggttgctttttatggggaggcgcctatgggcgtggcgggccgcccagcccggtcgcgcgcctcccggacacgtgcgcccggagggcggcggtctcctcgtcgcccatgagcagtttccgaaactgcgccatgatgtccacgacgcggacccgcggccccagcacggactcgctattcaggggggcgggggggaaggccgccaggtcttcgagcaggaaggcggggtctgccgtcccgctcacgggcgcccggggcgccgaggacgcggggcgaaggtccacgtgttccgcggcggcgcgcacgtccgcccaaaatttggcgggggtggtccgcgcgtacaggggctgggtcgcgcggaggacgcacgcgtagcgcaggggggtgtacgtgcccacctcgggggccgtcgacccgccgtcaaacgcggccagggccacgcacgcgaccaccgtgtcggccaggcccagcagccgctgcaggatgagccccgtcgccagcacggcgcgcgcggccgccgcgtcgtccctgcgccggcgcgcgtccccgcaggccagggcgtatttcagggtaacggtcgccagggccgtgtgcagcgcgtacacggccgcgcccagcacggcgttcagcccgctggtggcgagcaggcggcgcgccgcggtgtcgcccagcgcctcgtgctcggccgccacgaccccggggctgcccaggggcagggcgcgaaacagcgcctcctgctccacgtccgcaaacgcggggtgggcggagtgcgggtgcaggcgcgcccccacgaccaccgagagccactggaccgtctgctccgccaggaccgccagcacgtccaggacgcgccccgcaaacgcggcctcccgcgggagcacgcatttgacggcgccggggttgaagcgggcgagcagagccccggtggcgatgtacgtcatgcgccccgcgtagcgggcggccacgcgacagtcgcgccccaggagcgcgcgcaccccgggccagtacagcagggaccccagcgaactgcgaaagaccgcggcgtcggggccggggtgggggggcgcggcccctcccgcgctgagcagcggcacggcggcggcccccacgggccgcaacgccgtgaggctcgcgaactgccgtcggagctcggccgccctgtcgtcgagctccgagccgcgcccctccgtgtgcaggcgcgtcccgcagacccacccgttgatcgccacccgcacgatggcgtccaccagaaagcccatcgcgcgggaggggctggtttttgcccgccgatccgtcaggtcgaggatcgcgtcgcccgtgacgtaccaggccagcgcctcgccctgctgcagcgtctggcggaaaaacacctttgggtcggccggggaggcaaagtgcatgacccccacgcgcgacagcccgaacgcgctatccggacacgggtagaacccggccggatgtcccagggccagggccgagcgcacggactcgtcccacgcggcgactcggggggtcaggcggtccagggggaatgccgcctgcagctccgggcccgacacgcggcccgcgagaatctcgaccgtcgcggaaggccgcgccccggcgccgtcatcgtgcgcgacggcggcggggtagtcgtcctcctcgtagttgagctcgtccaggaacagcggcgagggcaccacccgcgaaccgcccacccgccccaaaacgtcgcgtgggtccatcgggcccaggtagcctccccgcggggcccgcgtgatggcgctgtcccggcgtccgcgaacggactggctcctggccgtaacggacctggggcgcggaaaggacgcccggcgggggggcgccgccgcccgggcctcggacgcgcgtcgggacccggggtgaccgcgggcctcccggcgacggcgcgggggcggctcttcgctcgccatctcccccgcggcctcgacctcgctgtcgtcgtccacgttaaacaccgcccgcaggtaccccattaacccgactccaccgccctcgggctcgtcctccacgggcgagtcggcgcgatgcgcggacggggcatgggaccgggtggaggcgcgcctccggcgtacggcatgcccgcgcacggacatggtggccggaggcccgattttttacacacgccctccccgcagacggacgaggaaaggggtggtgcgaggggggaggcccaaacggggaggtggggggtagggggcggtcccagggagcggggggtaggaaccggcacgacgggaacagagaaaacgcgaccgctccaacaagggtgggggggtgggcctcgtccccacgcagacccgcgggcaaatgcgagaacgggacccgcgcgcctgcctttatacgcggaccccagcaccacgagccgttctgtgacgcgaatctacacgaccgcgggctcgtaggcgcgactaacgcccaacccaacggcacacaccccccaccccgcgcgtaaccccatttctttcatggtcccgtaataaacagccaacgcacgccgcgtatgatgagttgcttgccaatgtttattgctgtggttgcgaaccctctatcgcgatacagacggaggtgaggcggggcggtggtgggggggggcgcgccgcccggtcgcacatcctaccccccaaagtcgtcaatgcccatggcatcggtaaacatctgttcaaactcaaaatcgtccacgtccaaagccccatacgagacggggtcgtgggtcattcccggggagggggactccacgtcccccagcatctccaagtcgaagtcgtccagggcgtcggcgggcgtcatatccacctcctcgccgtccaggcggagttcgtctcccaggctgacgtcggtaatgggggcggtggtggacagtctgcgggggcgttgtcccgcggagagaaacgacatgcgcggcgccaccagcccggcctccgcgggagcgtcatcgtcgtccgggaggtcgagcaggccctcgattgtcgatccgtaattgtttctggtccgcccgcggctatacgcgtgctcccgcatgacggactcgccctccgaggtcgcgacgctggagtacgagtccaacttggcccggatcagcagcataaagtacccagaggagcgggcctggttgccctgcaggacgggcggggtcgtgaggggcgccccgggttcctccgccgccgcacttcgcaccagcgggaggttcaggtgctcgcgaatgtggtttagctcccgcagtcgccgggcctccacgggaactccccgcacggtgagcgatccgttgataaacatcaggggctgaaacagacacgccaactggcgccagctctccaggtcgcagcagaggccgtcgaacagatcgggccgcatcatctgctcggcgtacgcggcccataggatctcgcggctcagaaagaggtatagatgcagaaacaggacgcgcgccaggcgcgcggtctcgcggtagtacctgtccgcgatcgtggtgcgcagcatctcccgcaggtcgcggttgcggccccgcatgtgtgcctggcggtgtagctgccgaacgctggcgcgcaggtaccggtacagggccgagcaaaaatttgccaacacggtccggtagctctcctcccgcgcccgcagctcaccgcggaaaaactgcgccatggcctcgtagtacgaaggcagctcgtcgcgggtggcgggcagggtggggaacgccacgtcgccgtgggcgcgaatgtcgatcggggagcgctcggggacgtgcgcatccccccagtcgatcacgtcgctgggcagcgtcgacagaaacttgcactcccggtacatgtcggcgttggtcgggaacccagagaacaggtcctcgttccaggtatctagcatggtacacagcgcgggacccgcgctgaagcccagatcgtcgaggagacggttaaacagggccgcgggggggacgggcatgggcggcgagggcatcagctgggcctgactcagccgaccggtggcgtacagcggaggggcggctggggtgttcttgggacccccggctggcctggggggcggtggcgaaaccccgtccgcgtccgcaaacagatcgtcgaccaacaggtccatgggggcggttgggtccgggaataacgatctcgagaggcgaatgagacgtgcccgagcgcccggcggcggagagggggggagggatccgggacccgcgacagaaaaaggccggggccctcgcgaagggaatcgccgggggtgccgtgcgtccccgaggactgacatctcgcgtccaccaccccgcatttaagtatcaccccagtgccgccccaaacctcgtgacttccccaccgctccgggcggcccgtcccccgcgctcggaagggaggcgtgtccttcctcccgcccctcccgcccctcccgcccctcccgcccctcccgcccctcccgcccctcccgcccctcccgcccctcccgcccctcccgcccctcccgcccctcccgcccctcccgcccctcgccacaaacgcgtgctgacagcgaagtggttaaatcgaccgtgatgctttattgtctgtcgtctgaacgcggtcggggtcgctactcgagggggcggcggggacgggaagccgagcgggcgggggcccgtgcggtcgcggcggcacgccccgcggggcggccccgggcggccgcggtcgcgtcgacgtcctgcgccgcgtcgggattcaccaactcgttcgcgcgctgcaggaggttcttgccctcgcagaccgtcacgcgaatggtggtgaggtcgaggagctcgttgaggtcttcgtcggtgtgcggccgcgacatgtcccacagctgtaccgccgccagccgggcgtgcgtggccgccaggcgcccgaccgcggcgcagaagacgcgcttgttgaacccggccacccggggggtccacggcgccgtggggctcggtggggcggtgctgaagtgcagcttcttggccagtccctgggcgggtgtcttggttcttcccgaggccgtgggagcgggggcgtctaggagcacggcggagtcggcctgggcgggtcgcctgccgcgggcggggtcggtcgccggggtcgcggaggccttaggcgccccgcgcgtcattttgggggtccgcgcgggaggggcgtgcgagcgcccgccggcgcccacggggcccccggggggtggaggagcgcgcgcggggccggggccgtgagagcccgcgacggacgccgaacgacgcggtcgcgcggtatcccgggactcgtcgtcgtccgaagacgagtcccggtagagggcatacccagcctcgtcataatggagaaagcgaacctcgcccctcgggcgcgcgcgcatcgggccagcgccgcggcggaagtcgtcgcgcggactctctgggtccgccggggagaccgggccatagtacagctcctcgtgggtcccgcgcggcgcttcccgcggacacgacttgacggagcggcgagaggtcatggtctatcggagacaccggggacgcccgtgcggatcacagggaaggcgtcggcgaaggaggcagagagcgtcggaaggcggcgagggagggaaagagggagaccggcggggtacgggagagcagcgagggcctgcgtaacccacgggggccgcgggagtggctccctgcgggttgcgggggagagtttataggaagtggatataaccgcaggcgacgggactaaccaatccccgggggggcaacggacagacacgccccgaacaggcccgacttccgcgaggaagcaaaggccgggggccgcccaacgacacgcccaccccttcccaacagggcgggctcaggctgacccggcggccagtgcccgctgacatatctgatacacgtgcgcgatcatacatacgcccatcgaggtcatgcctagataaaagggcaccaggacccccgggacggacaccacaccggcgctgtcgccccggcattgcgcgtccccgataacgccgcgtgcgcctgccgcgttcggcggctccccgggcacgcccgcgacgagcgcgacgaacaacagcaccacccagcggcccagtcttgcgggtttccccgtcatcgcggcgatgagtcagtgggggcccagggcgatccttgtccagacggacagcaccaaccggaatgccgatggggactggcaagcggccgtagctattcgcgggggcggagtcgttcaactgaacatggtcaacaaacgcgccgtggattttaccccggcagaatgcggggactccgaatgggccgtgggccgcgtctctctgggcctgcgaatggcaatgccgcgggacttctgcgcgattattcacgcccccgcggtatccggccccgggccccacgtgatgctcggtctcgtcgactcgggctaccgcggaaccgtcctggccgtggtcgtagccccgaacgggacgcgcgggtttgcccccggggccctccgggtcgacgtgacgtttctggacatccgggccacccccccgaccctcaccgagccgagctccctgcaccggtttccgcagttggcgccgtccccgctggcagggttacgagaagatccttggttggacggggcgctcgcgaccgccgggggggcggtggccctgccggccagacggcgcgggggatcgctggtctacgcgggcgagctaacgcaggtgaccaccgagcacggcgactgcgtgcacgaggcgcccgcctttctgccaaagcgcgaggaggacgcaggctttgacattctcatccaccgagccgtgaccgtcccggccaacggcgccacggtcatacagccgtccctccgcgtattgcgcgcggccgacggaccagaggcctgctatgtgctggggcggtcgtcgctcaatgccaggggcctcctggtcatgcctacgcgctggccctccgggcacgcctgtgcgtttgttgtatgtaacctgaccggagtcccggtgaccctacaagccgggtccaaggtcgcccagctgctcgtcgcggggacccacgccctcccctggatcccccccgacaacatccacgaggacggcgcattccgggcctaccccagaggggttccggacgcgaccgccaccccccgagacccgccgattttggtgtttacgaacgagtttgacgcggacgcccccccaagcaagcggggggccggggggtttggctccactggcatctagaccgcgcctcgcgtcgggccagatggggccccggtcaataaagagctctgtttcgcatatgccctggtgttggcggttttttttgttgtctgtctgcccggcgctcggttgtccgttctgtcgtcgctatcacatacgcacaaacacacgggtagagtggaaccgaaaccggtcgacgtttattcaccacacagaaacacaagctaagcgagaaggaggggggcctcggtcgacgaggcctggcgtttgggggcggacgtgcgatgacgtgggtccggtgtagggtccgcggggggcacgggcccggggcgaacgggggatctgtcgccggcgtgggtgactgggaccgacgcaacctccggggcttgtgccctcgtaggcccggggggggcctcggtcgctccaagccccgcggtgcgggtccctccggccagagccgaggtggagagaccaagggcccgctccgcgatcgccacgtcctccatgaccacgtcgctctcggccatgctccgaatggcctgggagacgagcacgtccgccgacttgtccgcggcccccaccgacatgtacatctgcaggatggtggccatgcacgtgtccgccaggcggcgcatcttgtcccgatgcgccgcaacggccccgtcgatggtggagccctcgagtcccgggtggtggcgcgccagcctctcgaggttgaccatgcaggcgtggtatgtgcgggccagggcgcgcgccttcacgaggcgccgggtgtcgtccagcgactctagggcgtcgtcgagcgtgatgggggcgggcaaaagcgcattgaccaccgccagggcctcctgcagccgcggctccgcctccgagggcggagccgcggcccgaatcatctcatattgttgttcctcggggcgcgttccccaaccgcacagcaccccgagcagggacgccatcccggaacacgcgcgcggctctgcgccggctttcccccaccccaccccctccgggttcgcaggggcgatggggacggaagactgcgatcacgaagggcggtcggttgcggctcccgtggaggttacggcgctgtatgcgaccgacgggtgcgttatcacctcctcgctcgccctcctcacaaactgcctgctgggggccgagccgttgtatatattcagctacgacgcgtaccggtccgatgcgcccaatggccccacgggcgcgcccaccgaacaggagaggttcgaggggagccgggcgctctaccgggatgcgggggggctaaatggcgattcatttcgggtgaccttttgtttattggggacggaagtgggcgtgacccaccacccgaaagggcgcacccggcccatgtttgtgtgccgcttcgagcgagcggacgacgtcgccgtgctccaagacgccctgggccgcgggaccccattgctcccggcccacgtcacagcaactctggacttggaggcgacgtttgcgctccacgctaacatcatcatggctctcaccgtggccatcgtccacaacgcccccgcccgcatcggcagcggcagcaccgcccccctgtatgagcccggcgaatcgatgcgctcggtcgtcgggcgcatgtccctggggcagcgcggcctcaccacgctgttcgtgcaccacgaggcgcgcgtgctggcggcgtaccgccgggcgtattatgggagcgcccaaagccccttttggtttctgagcaaattcggcccggacgaaaagagcctggtgctggccgctaggtactacctactccaggctccgcgcttggggggcgccggagccacgtacgatctgcaggccgtgaaagacatctgcgcgacctacgcaatcccccacgacccacgccccgacaccctcagtgccgcgtccttgacctcgttcgccgccatcactcggttctgttgcacgagccagtactcccgcggggccgcggccgctgggtttccgctgtatgtggagcgccgcatcgccgccgacgtacgcgagaccggcgcgctggagaagttcatcgcccacgatcgcagctgcctgcgcgtgtccgaccgggaattcattacgtacatctacctggcccactttgagtgcttcagccccccgcgcctggccacgcatctccgggccgtgaccacccacgaccccagccccgcggccagcacggagcagccctcgcccctgggtcgggaggcggtggaacagttcttccggcacgtgcgcgcccagctgaacatccgcgagtacgtaaagcaaaacgtcacccccagggaaaccgccctggcgggagacgcggccgccgcctacctgcgcgcgcgcacgtatgccccggcggccctcacgcccgcccccgcgtactgcggggtcgcagactcgtccaccaaaatgatgggacgtctggcggaagcagaaaggctcctagtcccccacggctggcccgcgttcgcaccaacaacccccggggacgacgcggggggcggcactgccgccccccagacctgcggaatcgtcaagcgcctcctcaagctggccgccacggagcagcagggcacgacgcccccggcgatcgcggctctcatgcaggacgcgtcggtccaaacccccctgcccgtgtacaggattaccatgtccccgaccggccaggcgtttgccgcggcggcgcgggacgactgggcccgcgtgacgcgggacgcgcgcccgccggaagcgaccgtggtcgcggacgcggcggcggcgcccgagcccggcgcgctcggccggcggctcacgcgccgcatttgcgcccggggccccgcgctccccccgggcggcctggccgtcgggggccagatgtacgtgaaccgcaacgagatcttcaacgccgcgctggccgttacgaacatcatcctggatctggacatcgccctgaaggagcccgtcccctttccccggctccacgaggccctgggtcactttaggcgcggggcgctggcggcggttcagctgttgtttcccgcggcccgcgtagaccccgacgcctatccctgttattttttcaaaagcgcctgtcggccccgcgcgccgcccgtctgtgcgggcgacgggccctcggccggtggcgacgacggcgacggggactggttccccgacgccggtggtcccggcgacgaggagtgggaggaggacacggaccccatggacacgacccacggccccctcccggacgacgaggccgcgtacctcgacctgctacacgaacagataccagcggcgacgcccagcgaaccggactccgtcgtgtgttcctgcgccgacaagatcgggctgcgcgtgtgcctaccggtccccgccccgtacgttgtgcacggctccctgacgatgcgtggggtggcgagggtgatccagcaggcggtgctgttggaccgcgacttcgtggaggccgtagggagccacgtaaagaactttttgctgatcgatacgggcgtgtacgcccacggccacagcctgcgcttgccgtatttcgccaagatcggccccgacggctccgcgtgcggccggttattgcccgtcttcgtgatcccccccgcgtgcgaggacgttccggcgttcgtcgccgcgcacgccgacccgcggcgcttccactttcacgccccgcccatgttttccgcggccccgcgggagatccgcgtcctccacagcctgggcggggactatgtcagctttttcgagaagaaggcgtcgcgcaacgccctggagcactttgggcgacgcgagaccctgacggaggttctgggccgctacgatgtgcggcccgacgccggggagaccgtggaggggttcgcgtcagaactgctggggcgaatagtcgcgtgcatcgaggctcactttcccgagcacgcgcgggaatatcaggccgtgtccgttcgccgggccgtcattaaggacgactgggtcctgctgcagctgatccccggccgcggcgccctgaaccaaagcctctcgtgtctgcgcttcaagcacggcagggcaagtcgcgcgacggcccggacctttctcgcgctgagcgtcgggaccaacaaccgcctatgcgcgtccctgtgtcagcagtgctttgccactaaatgcgataacaaccgcctgcacacgctgtttaccgtcgatgcgggcacgccatgctcgcggtccgctccctccagcacctcacgaccgtcatcttcataacggcctacggcctcgtgctcgcgtggtacatcgtctttggtgccagtccgctccaccgatgtatttacgcggtgcgccccgccggggcgcacaacgataccgccctcgtgtggatgaagataaaccagacgctgttgtttctgggcccgccgaccgccccccccggcggggcatggaccccccacgcccgcgtctgctacgccaatatcatcgaaggtcgggccgtgtccctcccggccatccccggcgccatgagccgccgggtcatgaacgtgcacgaggccgtaaactgcttggaggccctctgggacacccagatgcgcctggtggtcgtcggttggtttctgtatctagcgttcgtcgcccttcaccaacgacgatgcatgttcggcgtcgtgagtcccgcgcacagcatggtggccccggcgacctatcttttgaactacgccggccgcatagtgtcgagcgtgttcttgcaatacccctacacgaaaatcacccgcctcctctgcgagctatccgttcaacgccagaccctggtgcagctgttcgaggcggatccggtcaccttcttgtaccaccgcccggccgttggcgtcatcgtgggctgcgagctgctgctccgcttcgtggccctcggtctcatcgtcggcaccgctctcatctcccggggcgcctgcgcgatcacacaccccctgtttctaacaatcaccacctggtgtttcgtgtccatcatcgccctgacggagctgtatttcatcctgcggcggggctcggcccccaaaaacgcggaaccagcggcccccagggggcgctccaaagggtggtcgggcgtctgcgggcgctgctgttccatcatcctctccggtatcgccgtgcgcctgtgctatatcgccgtcgtggccggggtggtgctcgtggcgcttcgctacgaacaggagattcagcggcgcctgtttgatctgtgacgtaacgcctcttccgttggaagaggcggacccagtcgcccatgcaaattaaatacacgacccgcctcgggcctacgcaccctcgcacgtcgcatgcaaattaaaatcgtgcacagagccgatccggcctcgggtctgcttgcccctcccccggcccagcacaggcaggctcgtccgacttccgcatacaccccaccctaccgcgtgcttccgcacccccgcctacgcgtgtacgcgaaggcggacccagacctgccgtatgctaattaaatacataaaacccaccctcggtgtccgattggtttctggggacggcgggggcgggggcggtgacgcccgacggggagggacaaggaggagtttcggaaagccggccccggtcgtgcgggtataagggcagccaccggcccactgggcgctgtgtgctgccgtgtgccgaccccggttgcgcgtcggtgccgctcctcgattcggacccggccactctcttccgacacgcgccccctcggaggacacccgccatcccagccccggcgacctacaacatggctaccgacattgatatgctaatcgacctaggattggacctgtccgacagcgagctcgaggaggacgctctggagcgggacgaggagggccgccgcgacgaccccgagtccgacagcagcggggagtgttcctcgtcggacgaggacatggaagacccctgcggagacggaggggcggaggccatcgacgcggcgattcccaaaggtcccccggcccgccccgaggacgccggcacccccgaagcctcgacgcctcgcccggcagcgcggcggggagccgacgatccgccacccgcgaccaccggcgtgtggtcgcgcctcgggaccaggcggtcggcttccccccgggaaccgcacggggggaaggtggcccgcatccaacccccgtcgaccaaggcaccgcatccccgaggcgggcggcgaggtcgccgccggggccggggtcgatacggccccggcggcgccgactccacaccaaacccccgccggcgcgtctccagaaacgcccacaaccaagggggtcgccaccccgcgtcggcgcggacggacggccccggcgccacccacggcgaggcgcggcgcggaggggagcagctcgacgtctccgggggcccgcggccacgaggcacgcgccaggccccccctccgctgatggcgctgtccctgacccccccgcacgcggacggccgcgccccggtcccggagcgaaaggcgccctctgccgacaccatcgaccccgccgttcgggcggttctgcgatccatatccgagcgcgcggcggtcgagcgcatcagcgaaagctttggacgcagtgccctggtcatgcaagacccctttggcgggatgccgtttcccgccgcgaacagcccctgggctcccgtgctggccacccaagcgggggggtttgacgccgagacccgtcgggtttcctgggaaaccctggtcgctcacggcccgagcctctaccgcacattcgcagccaacccgcgggccgcgtcgacagccaaggccatgcgcgactgcgtgctgcgccaggaaaatctcatcgaggccctggcgtccgcggatgagacgctggcgtggtgcaagatgtgcattcaccacaatctgccgctccgcccccaggaccctatcatcggaacggcggccgccgtgctggaaaacctcgccacgcgcctgcgcccctttctgcagtgctacctgaaggcccgaggcctgtgcgggctggacgacctgtgctcgcggcgacgcctgtcggacattaaggatattgcctcctttgtgttggtcatcctggcccgcctcgccaaccgcgtcgagcgcggcgtgtcggagatcgactacacgaccgtgggggttggggccggcgagacgatgcacttttacatcccgggggcctgcatggcgggtctcattgaaatactggacacgcaccgccaggagtgttccagtcgcgtgtgcgagctgacggccagtcacactatcgcccccttatatgtgcacggcaaatacttctactgcaactccctattttaggcaagaataaacatattgacgtcaacccaagtggttccgtgtgatgttcttggcgcgcgcggcgggtggggcggagactccggggcgatgccggcgtgcgcgtgggaggagggcgatgacccaccggataaatgtggggccccggcccggcccgcttcatagcgcgtccaggaactcacggcagacgcgtattcaccgacccccccctcgcaacatgacaacgacgcccctctcgaacctgtttttacgggccccggacatcacccacgtcgcccccccgtactgtctgaatgccacgtggcaggccgaaaacgccctgcacacgaccaaaacggaccccgcgtgcctggccgcgcggagttatttagtccgcgcctcctgctcgaccagcggccccatccactgttttttctttgcggtgtacaaggactcgcagcactcccttccgctggttaccgagctccgcaacttcgcggacctggtcaaccacccgcccgtcttgcgcgaactagaggataagcgtggggggcggctgcggtgcacgggcccattcagctgcggaaccatcaaggacgtctccggtgcatcccccgcgggggaatacacgataaacggtatcgtgtaccactgtcactgtcggtatccgttctccaaaacctgctggctcggggcatccgcggccctacaacaccttcgctctataagctcaagcggcacggccgctcgcgcggcagaacagcgacgccacaaaatcaaaatcaaaatcaaggtataacccacccccttccctccgagtccgtatgcaacctcattaataaagagtgagaaccaaccaaaacagacgcggtgtgagtttgtgggttataggaacccggtaaataccacgcgacgaaccagcatgtgtgttaacgcaacttttattcgttgtatcgcgggaggggggaagcttaccgccaaaggaaggccaagatgataacgacgaccaccgcgaccaccccaaaaaccgcatgacgacacgtcccgccacaccaccctggggcttggggcgtgtcggagctcgacgcacagcgggccgcgcgttgggcccggtacagctctcgcgaattgacaagcgggggtcgccacgtgcgcgagctttgcacgcggggttggtcggccggccccacggacccgcccggtggctcggtcggacatgcggccatgaccatggcgtaggtgggggggcgatccgaggtcgcctctgcgtaagtagggaggcccgacgggaggtcgcctcccacgccagggtgggccccaatcatagtttccggtagaaacaggggggtctccacaaacaacccccctgggccaaagctccggcgccgcgcccgtcgttcggcgcggcgcctggcgcgccgagcggcccgccaggcggcgcggcgcgagcggccacgctcacacacctcgccgtcaccggaagaagccggtgaaacaagcccaaccggcgacgtccctgcagagtacggtggaggcgagtccgtgggggtgtcgatatcaataacgacaaactggcccgcgctcgcgccggccacactctcgtatgggggcggggcgtcaatcacgctatcatctccgtcatccctgcatgcgtgggcatgcccagcccccaacgccatggtggggattcgcggctcagaagcctgcatgtcgtgtggtcggtcgtagtccaacgtgcctcccccacccaccacacagccggtccccacgccgaccactagaccgcagacgtcgcccaaccgaggtccccgtgcacagaccgcgccttttatagccccaggggttgctaattaacgcacgcatgcagacgcaatttattttgctcccccgcgtcctcccctcccctgcgcacacgtgataggtcttgggaacccgaggggcgacgcggggaaagcgcgcccccgcccggccgccgcgcgcccccgcccggccgccgcgcgcccccgcccggccgccgcgcgcccccgcccggccgccgcgcgcccccgcccggccgccgcgcgcccccgcccggccgccgcgcgcccccgcccggccgcccgcgtcgcgccggcgccccctcccggcgcttccggggtctttccttccttccccgccgcgaccccggccccgccccaccgccccgcccggcaggggggccccggcgccgcgcagaacacacagacgaacacacggtggcgatcttttctttacttcggcggaccagcgagccccggccccggcccgcgccccgccgccacacccacggcaccccccccccgccgcccaccccggggtccacacaggagcgcgcgggcggcagaaacgcgggcgcggcggcggtcggggtgggagtggtggtgggggacacgaaaacacacccacgacactctccccccaccccgaccgccgccgcgccccaccggcgggatcgcggcgagacgcagccgggcccccccccaccacccgcccacccacctaccccgcgcccgcagcctccggcagcacgccgaccaccgccgccaccccccaaacagccaaggcgcggtggggggcgtggtggtgaacgatggggggaacacgggggggaggggtccggggcgaggcgggcgggcgaaggaagggggggtggtggcggcggcggtggaaagcggaaaaacggaggatggaagggcagaagatggggagtcccgatcctcctcctgcatcccctcgccttccattctccggccctccgcgagtcccgacgccccccccccgccgcccgacgaaggagacccaagcaccgcagccggagaggccgagcggggagtgggcggccgggcgggaggatggcggagagagagagagagagagagagagggggggggggggagagggaaagcaacgggaaagagaggcgcgcggaaaagcagcaagaggggggacggggcgagccgggcagagtgcggagcccccggagcccgcggccgcagccgagcagcgccgcgggctccggggccgggccgggccggcaacgccccgcgccggccgcggcggagagaacccctgtgtcattgtttacgtggccgcgggccagcagacgggccgcgggccagcagacgggccgcggcgccagcggcccacgcctcccgccgcattaggcccccgcgggcatccggcggccggccccacgcccttccattaaacactcccacgttgggggggggcgcgccagctgagtgctctgcggttgcgggcgccgtgcccggagatccattaagccgccggagagcccgagccccgcccgcgtgttgctgtgggcatttctgctgcgtcatccctgtctttataaaaccgggggcgcggcagcaacgaacgcaggggcccgccgccgatcgagagggactccggagaaggaaggctgctccgcgcaccggcgcgcccttctcctctcccctccctacctccccctctcttcccccttttttcccccgcctcccgtcttcttccgcgcctccgagggtccgcctctgcctcggggacccccgggcgggccggggcttggccgccgaggtgcgccccggccggaggggcccccgcacctcggcggccgccccctccggcgccgcgcgttcgcgaaaggcgcgaaaggggcccccggaggcttttttcgattcccggccgggggtcccgggtagccgcccggcgccgggcggaaggcgtcccccgcccggcggtccggcccgggcccccggcggagcgcgggggccccggggccccgggccgcgccggcggcgtttccgcgttccgtttcttctccctcccggccgccccgctcccgggcccgaccctcgccccttcccttctcctcgtcttcccccgtcccgccgcgccccttccctcttccttctctctctctgtctcgctctcctcacatttcccccccccccccgccgccgccgccctctgcccgcgtcccaccgagacgccgcgccgcgtgagccgtccgccgggggacccaggctccggggggggggggcgcctgcgtgtgtctcgtgtgagagagcgcgcccctcgaacgccgcgcgttctcgcaggtaggtttagggtcgtacaggtgagcttctgctgaggcggcgggagagggggggggggcgggcggaagagagaagagagcaggggttgggggagaactgttcttcctccccctttcaagaaacacgaggcgggggtcccagaaagggcaggcaggtcagccgcaccgcccgcgagccaacccgtatcctttttttctaggtgtttttgtttttgtttctgtttttgtttgttttgttattattttcgcggatccggcgtgttcggatccaccccccctttctccttcctcttcccttccacccacccccgtttcccccccccgtggtgtcgtccgggggcgtcgttcccagggggggcaggcgcgggtcgggcccatacgcccaccgcccccacgcgccggtcacccccccccaacaaccccaaaggcgcgtgcccagccacagccgtgggtgtggcgcccgtccccttcctctaccgcgtgggcgcgggcgggggggtggtggtagtggtggcggaaggaaacgggccgggggccggggccgctagggaaaggtaggcacgcgcgcggtgtgtcgacttgcatgccccgcaaaacgcgtcgtgtcgtgttgtgtcgtggtgggccgtgttgtggtgggccgtgtggtgtggtgtggtgttgcgaacgcgcgagccccctcgccccgatgggagtctccccgcagccagggtaaggaggggcgggcgtggcgggcaggtgtgcgggcggggtggggtgagtgcggttgcatgcctcgggtctcctcttcctgctcctcctcctttctcccagccagggtgaggaggggcgggcgtggcgggcaggtgtgcgggcggggtgggcgccggggcgggggtgggcacgggcgtaagtgcgggtgcatgcctcgggtcttctcttctccctcctccttcctcccacccgtccccgggggcagagggcgtgcatgcgttgtgattcaaccgccctcgcccccgccccactttccccccctctctatcaaagttccctggcccctggcttcgcgccggtggtgcggctgaccccccccctcctccctccccgagccaggcgccctcccactcctgcccaccacccccagggtctggccggccagacgtgcgtgctctgcacgatcgggcccccctccctgtcaacacggacacactctttttttacccgccagccagcccgcccacccaccaagacagggagccagaacgcaggccgggccccggctctgttctatcataaagaccaacaggcctcgggggtgggggcggcttctcgtgcccgccccccctcctcctcctccctttccccccccccatccccggcccccctgcgcgggggagctgcatcaaaggccaacaacaaagtgtgtcaaaagcatcacaaaactttattgtaaaatttttataaatataaagttttttttcctcaagttttcaacaaggccagaaagtccataacaaaatgctggtgtgtgttgctgttcggggccgtgtccgtccccccccactcccacccccacttcctgtctcctccccgtctttcccccccacctccccctgcccccgaggcgcctcggccggtggtccggtggggggcggcttccctttgggcagcaagccgagtgttagctccccctactccccgtggcccgcgggggcgtcgccggccggcgcgggcgcgccctgctcccgagaccacgggtggcgcgaccggaggccgtggaagtccagcgcgcccaccagggtgccctggtcaaagagcatgttgcccaccggggtcatccagaggctgttccactccgacgcggggggcgtcgggtagtcggggggcctcacgcagttgcgcgcgtgctcggggagcagggtgcggcggctccacgcgggggccgcggcccgcagcaggtccgccacgttccccgtctggtccacgaggaccacgtaggcccctatgtggcccgtctccatgtccaggacgggcaggcagtcccccgtgaccgtcttgttcacgtaaggcgccagggccacgacgctcgagacccccgcgatgggcaggtagcgcgtgaggccgggcgccgggtcgcgggccccgggctcggggccgccctccgcgtggcgcgtcttcctggcacacttcctcggcccccgcggcgcagcagcgcgggggccgagggaggtttctcgtctctccccagcgccggacgcggacgcgacgctcccaccagccccgcccgcagaggaagaggcggaggaggaggaggaggaagaggaggcggcggaggaggaagaggcggcggaggaggaagaggaggcggcggaggaggaagaggaggcggcggaggaggaagaggaggcggcggaggaggaagaggaggcggcggcggcgaccgcggcctgggacgacggagacgccgacgggggcgcggcgcccgcggacgccggggcgagcggcccgtggccgcggtcgcccgagtccgagtccggggcccggcgcggcgccgccctcttggcccccaccccctggggggcgaggggcgagcgcggggcggcggaggaagaggcggaggacgaggccgcagggcccgagtccgacccgcgcctcttccgggggcgggccgccgccccctccgcggcgtggggggcggcaccgggggtgttggtgccgcgggggaccccgggtcctccctccgcgcccggccctcccgacccgcgcgcgtcggtcgcgcctgcccggcccagactctgtgcttgggtgtcggtctgagcctgggtcatgcgcgaccggggcgcgcggtgcgcgtccaccggcacggcgggcggcgcgggcccggccgcgtccgcgctcgcagacaccacgggggcggcggcggcgcggggcggactccggacgcgcggggcgacggccgcgcgggggcgcgccgcgcgccccgacgactgtggcagacctccccccccggggcccgaggacacctgcgcggaggaggaggagaaaaaggagagcggcccggggcccgcggggcggcgcggagacggcgggggagagtcgctgatgactatggggggctcctgggccgcgcggggctgtcccgcggggggcgtcctgccctccgccgccgcggcgtcttcgcccacccgccgcgcctgcgcgcgccccccgccggccgcagggggaagagaggccactctcggcacgacggccgcgacggcagggccgcccccagacccagatcccacccccgcccgcaacggggcgccgccgctgctgctgctccgcggggcgccagggggcgccggtcgggtcgcggcgggctgggaggttccgcgggtcgcccccgcaccgccgcccccgcgccggggcgctcttcggggggcgggcgggacgtagtccactgcagagggagacagagacgggagcccccggttagtgcccgacccccgcccgacccccgcccgacccccgcccgacccccgcccgacccccgcccgacccccgcccgacccccgcccgacccccgcccgacccccgcccgacccccgcccgacccccgcccgacccccgcccgccctcaccgtcggccaggtcatcgtcctcgtcgtccgtgccgggccacgggggggtgggcgacagggcgcggaccgtgtgtccccccagcgacagggagcgcggggccgtccgctggttgcccgtccagataaagtccacggccgtgccggcccgcacggccgcctcggcctccacgcgggtccgggggtcgttcactatcgggatggtgctgaacgacccgctggcggtcacgcccactatcaggtacgccaccggggtgttgcacaggggacacgtgttgcgcaacggaatccaggtcttcatgcacgggatgcagaaggggtgcaggcagggaaaactctggcagcgcaggggcggggcgatctcgtccgtgcacacggcgcacacgtcgcccccccctcccgcttccgcttcctcctcacccacgggcccacccccgcaggatccctgcgcgtcggcgggcgtggggctgccctggcgctcggccgggggccgggccgggggcgtggccgcgtccatcaggcccgcctcgaacatctccgtgtccgtgctgcccgcctcggaggtggagtcgcggtgaaggtcgtcgtcagagattcccacctcggtctcctcctccgagtcgctgctggcgagccactgcatgtcgttgagcatcccccaggcgtgcggggcggcgggctgcttgacaaagcaacgggggggatttagagggcgcggggcgtgaggcgggacccccgcgccgtgtcccccgtgtccctccctcaccccggccccccgcccgctgctttttgttcggaagggggggagaaaggggtccgtaaccaaaggtggtctgcgtcctttggattccgacccctcgtctccccccctgtcccccgctctcgggctcctccctgcctccctcgcccccccagagggtcggggggcggcgcacggcccacgggggtcccccgaccgcttaagcgggccgggggtcggccccgtcaagcgtccccgcccccgagcccaccgcccgcgaccacccccaacccgcagccgggtggtccggggaaaagggggggcctgagacccgggggtcgccctctcaccgtgccgggggtctgccgcggcggccgctcggggccggggtccgcccgggagctcgtgccgggccggggttccatgagccggggtagggtagactcgagacggcggcccgcggtctctctcttgccgggttttagtctctgtctctccgggtctcctcctcccgccgggccgccgctccgtcgctcgcagtgccggggtgcgaatgcggcccgaccgtcacacggggctgccttatacccggcgcctatccactcccccaaaggggcggcatttacgattcccccaatagccgcgcgccccggcgggggcggagggagggaatccccccctctcggggcggccccgtccccggggaccaaccgggtgtactccaagaaccccattagcatgcgccgccccccgccgacgcagatgggagtccccccggcgccccgccggcgcggccctgagtggtgcccgcccccggggagaaattcattagcatactaggaagcccaggggaccaataggggccgatcagcccacccacccggcggcgcgcgaggctctgcgtgttctgccaagaaagtaatcagcataacccggaaccccgagggagtaattacgcggggagcgaggggccgtccgaacgtttttaattaccataagcgggaatggcggcccgttaaaagctgctaattaccgcgagcgggaacgccggcccattaaaagttgctaattaccatgcgcggggatggcggccgggaccgcctattaaaagtttctaattaccataccgggaagccggtctagaggatccccgggtaccgagctcgaattcatcgatgatcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggatccatgtgccaccagcagctggtgatcagctggttcagcctggtgttcctggccagccccctggtggccatctgggagctgaagaaggacgtgtacgtggtggagctggactggtaccccgacgcccccggcgagatggtggtgctgacctgcgacacccccgaggaggacggcatcacctggaccctggaccagagcagcgaggtgctgggcagcggcaagaccctgaccatccaggtgaaggagttcggcgacgccggccagtacacctgccacaagggcggcgaggtgctgagccacagcctgctgctgctgcacaagaaggaggacggcatctggagcaccgacatcctgaaggaccagaaggagcccaagaacaagaccttcctgcggtgcgaggccaagaactacagcggccggttcacctgctggtggctgaccaccatcagcaccgacctgaccttcagcgtgaagagcagccggggcagcagcgacccccagggcgtgacctgcggcgccgccaccctgagcgccgagcgggtgcggggcgacaacaaggagtacgagtacagcgtggagtgccaggaggacagcgcctgccccgccgccgaggagagcctgcccatcgaggtgatggtggacgccgtgcacaagctgaagtacgagaactacaccagcagcttcttcatccgggacatcatcaagcccgacccccccaagaacctgcagctgaagcccctgaagaacagccggcaggtggaggtgagctgggagtaccccgacacctggagcaccccccacagctacttcagcctgaccttctgcgtgcaggtgcagggcaagagcaagcgggagaagaaggaccgggtgttcaccgacaagaccagcgccaccgtgatctgccggaagaacgccagcatcagcgtgcgggcccaggaccggtactacagcagcagctggagcgagtgggccagcgtgccctgcagcgtgcccggcgtgggcgtgcccggcgtgggcatgtggccccccggcagcgccagccagcccccccccagccccgccgccgccaccggcctgcaccccgccgcccggcccgtgagcctgcagtgccggctgagcatgtgccccgcccggagcctgctgctggtggccaccctggtgctgctggaccacctgagcctggcccggaacctgcccgtggccacccccgaccccggcatgttcccctgcctgcaccacagccagaacctgctgcgggccgtgagcaacatgctgcagaaggcccggcagaccctggagttctacccctgcaccagcgaggagatcgaccacgaggacatcaccaaggacaagaccagcaccgtggaggcctgcctgcccctggagctgaccaagaacgagagctgcctgaacagccgggagaccagcttcatcaccaacggcagctgcctggccagccggaagaccagcttcatgatggccctgtgcctgagcagcatctacgaggacctgaagatgtaccaggtggagttcaagaccatgaacgccaagctgctgatggaccccaagcggcagatcttcctggaccagaacatgctggccgtgatcgacgagctgatgcaggccctgaacttcaacagcgagaccgtgccccagaagagcagcctggaggagcccgacttctacaagaccaagatcaagctgtgcatcctgctgcacgccttccggatccgggccgtgaccatcgaccgggtgatgagctacctgaacgccagctgactcgagctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccaggttatccgtgtaaccgccagtccgtgcttgcctagcgaactcacccgtcccggctggcgtgcgcagcccgggccgtgttgcgggccctcttaaggggcggcggcaggacggggactcccgccccgcctcttttcccccggggagtcaacccccggggggggtgttttttgggggggggcgcgaaggcgggcggcggcggcgggcgggcggcagggcagccccgcgcgcccccttccccgtccctcccccggagccggccgctcccccgcgggcgccgcccctccccccgcgcgccgcggggctgccttcccgcgggcgcccccgcgcggcttttttcccgcgcccgcccccgcgcggcaagacggggactagcaggctgtgccgcagaccaccacacactcccaagctccccgcccccccgaagacgccagtcgcaccaccgctcgccctcgcagaccagacagttgcaccaagcacccgcccgcccgcacacggttccccgccaccccctccctcccctccatcccgccgagctcgcggcagcccctcccccccgcgcgccacggggctgcggtcccgcggccgcctcccccgcggccgcctcccccgcgccccgccccgggggcttcccccgcccctccccccgcgcccgcggccccgagctcgcagcagcccctccctcccgcgccccgtgccttccctcccgctcctgcgggggggctcgggccacctgaccttcgtaacctgcactcaggtcagagccccagaccccccgcgggcgcgggagacgtgccgcccacccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgaataaaccacacaaggcggtacgttttcgtctgtctcgttctttatttctcacacacgcgcgcggccatcgccgcgtctgtcttaaaggcgcacagacgcccgattccttccccctctccccatctcccccctcccccgctcccggaagtttcccccccgtcactccccaaacagtccgtcgtcgtcgtcctccagctccgcgtccatgtccacgggctcgcgcctcggcggcgtggccagccccgcggcggtccccaccacctccacgccgccgcccgccgcggccagcaccgtccccgcgcggcccgcggccgacgcccagcgtatctgcgggggcgggcccgcgtccgcgtcgtcgcgcagcaccagcgggggcgcgtcgccgtcgggctcgagcagcgcccgcgcgcagaactcccgccgcggcccgcgcagctccgccgggccgccgcgcacggcgtcgcgccccagcgccacgtagacgggccgcagcggcgcgcccaggccccagcgcgcgcaggcgcggtgcgagtgcgcctcgtcctcgcagaagtccggcgcgccgggcgccatggcgtcgcccgcgcccgaggcggcggcccggccgtccagcgccgggagcacggcgcggcggtactcgcgcggggacatgggcaccagcgtgtcggggccgaagcgcgtgcgcacgcggtaccgcacgttggccccgcggcagaggcgcagcggcggcgcgtcggggtacaggcgcgcgtgcgcggcctccacgcgcgcgaagacccccggcccgaacacgcggccggaggccagcacggtgcggcgcaggtcccgcgccgccggccagcgcacggcgcactgcacggcgggcagcacctcgcaggccaggtaggcgtgctgccgcgagaccacgggcccgtcggcgggccagtccgcggcgcgcacggcgttgacgacgatgaggcggcggtcgcaggcgccggccagcagccccaggaactccacggcgccggcgaaggccaggtcccgcgtggacagcagcagcacgccctgcgcgcccagcgccgagacgtcgggggcgccggtccagttgcccgcccaggcggccgtggcgggcccgcagagccggttgcccagggccgccagcaggcaggacagcccgccgcgctcggcggaccactccggggggggcccgcccccggcgcggcccgcggccaggtcctcgcccggcagcggcgagtagaggatcaccacgcgcacgtcctccgggtcgggcacctggcgcatccaggccgccgcgcggcgcagcgggcccgaggcgcgcagcgggccgaaggcggcgggcgcgccgccggggggcggggcggcgcagcgcgcggccagcgaggccagcgcgcgcgggtcgaacatgagggccgggcgccacggcgcggggaagagcgggtggtccgtgagctcggccacggcccgcggggcgcagtaggcctccagggcggcggccgagggcgccggcgtgtggctgggccccggcggctggcggcgccagccgccctgcgggtcggggccctcggcgggccggcgggtcagcgccgcggggcgcggcggccgcggcggcggcgtcggcggggcggggggcgcggcccccgcgggaggggcggccgcggggcggggggcgtccgcgcggctcttcttcggggggcgcggggcgccgcccggcggcgccctggccggggcggggctcttgcgcttgcgcgcctcccgcggcgcggaggcgggcgcggcgagcgagtcggccgcggcgacggtgtcggccagcagggggcgcaggctctggttctggaagagcaggtccgcggcggcggcggcggcggagctcagcaggcgcgggctccgcggcagcgccgggcccagggccccggcgaccaggctcacggcgcgcacggcggccacggcggcctcgctgccgccggccacgcgcaggtccccgcgcaggcgcatcagcaccagcgcgtcgcgcacgaaccgcagctcgcgcagccaggcgcgcaggcggggcgcgtcggcgtgcggcggggcggccgcgcccgcgggccccgggcgcgggggcgcggcgggccgggctccggccagccccggcacggccgccaggtcgccgtcgaagccctccgccagcgcctccaggatcccgcggcaggcggccaggcactccacggccacgcggcccgcctccgcgcgccggccgccgccaccaccgccggcgccgtcgtcgtcgtcgtcgtcgtcggccccggccggcgcggaggcgggcgcggcgctcaggcgccccagggcggcgagcacccccgcggcgccgtagccggcgggcaccgcgcgctcgtcggccggcgacgccgccgccgacggcaacggggcggcggcggcggcgggcttcccgcgggcgtcgtcgccgtcgtggcggttggcgtcgccgccgtcgtcgggggttcgcgccccggtcagcgccgcgttctcgcgcgccagcaggggcgcgtaggcgcggcgcaggctggtcagcaggaagcccttctgcgcgcggtcgtagcggcggctcatggccacggcggccgccacgtgcgccaggccccagccgaagcggcccgccgccatggcgtaccccaggtggggcacggcccgcgccacgctgccggagatgaaggagctgctgttgcgcgccgcgcccgagatccggaagcaggcctggtccagcgccacgtccccgggcgccacgcgcgggttctggagccaccccatcgcctccgcgtccggcgtgtacagcagccgcgtgatcagggcgtactgctgcgccgcgtcgcccagctcgggcgcccacacgggcgccggggcgcccgaggcctcgaaccgggcccgcgcctcctccgcctcgggcgccccccagaggccggggcggctgtcgcccagcccgccgtacagcacgcgccccgggggcggggggccggccccgggccacggctccccgctgacgtacccgtcgcggtagcgcgcgtagaaggcgccggaggccgcgtcggcgtccagctcgacccgccggggccgcccggccgtgaagcggcccgtggcgtcgcggccggccaccgccgcgcgggcccggcggcgctccaggcggcccgcggtcgccgcgggggtccgggccggggcgggctcggccctgggcgggctcggccggggcgccgcccccggggccctcgcgggcacccccgcctcctcgtcgtccgcgccgagggtcccgcccgcggcgtggtctgcggcgctggcgggggcgcgggcggcgtcgtcgtcgtcgtcgtcgtcagacgaggaggcggatgcagacgaggaggaggaggcggaggaggaggcggaggacgccgacgacgaggatccggattttgatgagtcagaggcggccgagcgccggcggggggcgcgccggcggcggtggtggtggtggtggtggtgtcggcggggcgccgggggtcgcggcgacaggctggccatggggtccgggtacgccccgcggaccgcggacgtcgtctccggtccgcggacccagcggcccgcgtcgcggtcgtcgtcatcgtcgtcgtcgtcgtcgtcgtcgttctcctcgccataatcggcgcgcatggagggggtccgcggcggagaaggcgagcgggccgcttcttcttccgcgccgtcgcgctccggggggggcgacgggatcgtgcgaacggcctcgtccaccatcgaggccagcagggccagctgccgcggcgagacgacgccgtccgcggcaggctcgtcgacggcctccccggacgccggggccgcctcgtcggcatcggcatcggcggcggcgtcgtcggcctcgtcttcgttctcctccggcccaccgtgccacccgaacccgggccgcgcggcggggcgacggtccgggttcggggtgggcggcggtccgtcggctggatccggagatccggggccgccggtcgtctccgccgcggcccggagacgtcccccgtcctcgtccgccatcgcgacctcggccccgcggccctgcgtcgtcgtcgtcgtcttcttcttcttccgctgctccgccgacatcgcctccgaccggggtgtgcgggggggggtcttcttcttcttcttcaggggcggcagtgggggggggtggttggcagtctctctcccccccgtgcggtgcgtgcgtgtgcctgtgtcttttcgcctctccgcgccgatcgggtagatcctggcggccgcgtcggtagccgcgctccgtgtggacgatcgccccgtcgcctggctgatatagtcctcggggcgcgcggggcggggggaaaggaggaggacgcggaggaggagcgatcgacgccgccgcgccccggctcgccggggttccgcccccaggtggaaccgcattatgcgcggccccgccccgacgcccgcgcgtccgcgtccgtggcggcggcccgttggtcgcgccgccgccggctccgcccgcgcggcatctcattagcgcccggcgcgggcggcttccgcttccgcccgcgatgctaatgagaccctcgtcgcgggcgggctcgctcccctgcccttccgggttcgtggtaatgagatgccggccccgcgctcccgttggcccccgccggccccaaaggggccggcgaggtcgccccgttggtccgcgggcggctccgccccaaagggggcggggccgcagggtaaaagaagtgagaacgcgaagcgttcgcacttcgtcctaatagtatatatattattagggcaaagtgcgagcgctggcgccctgcccggggcccgcgtcatcccgcgggctccgccccaaagggggcggggccgcagggtaaaagaagtgagaacgcgaagcgttcgcacttcgtcctaatagtatatatattattagggcaaagtgcgagcactggcgccctgcccggggcccgcgtcatcccgcgggctccgccccgaggcgggcccggacggggggcgggccgttcctcgcgcacataaagggccggcgtcccggtcgccgccgcaccaggggcacaccggctgcgcggcggagaccgggacggcagcggcggcatcgcgaagggggccacagcgagacagagacgccggcggcgagcggggcaccgacgcacccggatcggatcggatacagagacgcgggcgcatcggttccttttcgttctgcctttccctcccccccccccccccaccctgtacgtaccgcgaggacccatccacccactgcagccttatcgcaggtacggtgacccggggggccgggccggggggacgggccggggggacgggccggggggacgggccggggggacgggccggggggacgggccggggggacgggccggggggacgggccggggggacgggccggggggccggggggccggggggccggggggacggggggacgggccggggggacgggccggggggccggggggacggggggacggggggacggggggacggggggacggggggacggggggacggggggacggggggacggggggacggggggacggggggacggggggacggggggacggggggacgggccggggggacggggggacgggccggggggacggggggacggggccccgatcccaacatccgcgctttctcgcaggccgggcgccgccttcgtggacgggacaccggtgtggtaactggcgacaaggcgttgccactatggcagacatccccccggacccgcccgcgctcaacacgacgcctgcgaatcatgctcccccatccccacccccgggttcacggaagcgcagacgccccgtcctccccagctcgtcggaatctgagggtaagcccgacacagaatcggaatcctcctcgaccgagtcgtccgaggatgaggcgggagacctacgcggcgggcgccgtcgctccccgcgggagctcggggggaggtattttttggatctgtcggcagaatcgaccacggggacggaatcggagggaacggggccgtcggacgacgatgatgatgatgcgtcagacggctggttggttgacacacccccccgcaaatccaagcgaccccgaatcaacctgcgattaacgagctcccccgaccggcgtgcgggtgtggttttccccgaggtgtggagaagcgacagacctatccgcgcggcgcaaccccaggccccggcccagtcttccggggatcgcgcagccgcaccgcggcgctctgctcgccaggcccagatgcggagcggagccgcctggacgcttgatctgcattacatacgccagtgcgtcaaccagctctttcggatcctgcgtgccgccccgaacccgcccggcagcgccaaccgcctgcgccacctggtgcgagactgctacctcatgggctactgccggacccgcctggggccgcgcacgtggggccgcctgctgcagatctcgggcggaacctgggacgtgcgcctgcgaaacgcaatccgggaggtcgaggcgcattttgaacccgccgccgagcccgtgtgcgagctgccctgtctgaacgccaggcgttacggccccgagtgtgatgttggcaatctcgagaccaacggcggctcgacgagcgatgatgagatatcggatgcgacggactcggacgataccctcgcgtcccattccgacacggagggggggccctccccggccggccgggagaacccggaatccgcgtccggcggggctatcgcggctcggctggagtgtgagtttgggacgtttgactggacgtccgaggagggctcccagccctggctgtccgcggtggtcgccgataccagctccgccgaacgctctggcctacccgccccgggcgcgtgtcgcgcaacggaagccccagaacgcgaggacgggtgccgaaaaatgcgcttccccgccgcctgcccctatccctgcggccacacatttctccggccatgagcgcgggacccccagcccggtgtgtttgccaaacgaaaaataaacgccctacaagaaagcttttgtgtctgagtgtctggtttttctgggggtggaggaaggaacgacaaaaaaaagaaacaaacgcgacaccgctcgtacgtgtaatggggcgcagtgttttttattagcatcggggggggttagaggttggtgattggatagcaaacgtgggatgacggaggccactcgtcgccaacggccagcgggggcccggggttctgggggtcatcgtcccccgtctgccaggagggctcatcgggaatctcgggtcgccccatgcacgtaaaacacgggcgctgcgtggggtgggtcgccggatgcgggcgggatgatgcggggcggggtttgttgtgaggagccacgagggaccgtagccagcgaagacagctgcgttcccggtcgccgggcaccaccacgccgtattggtattcgtatcggctaaggagattttccagggggtgattaggcgctgcggggaacggggtccacgacacggtccgctcgggcaaaaaccgatcgggcaggggccacggttcccccacccacgcgtcgttggtcttcgtggcgatgaagcgaaaccccagccgggttttttgtgcgtactcgaaaaacggcacacacaggtccgccgccccgaccacccacaggtggtatagccggtgggggccggggcgctcttgatgcaggagccgaaaacacgcaggggcatccagaatctcgatgctttccagggggtcgtcctccgcaaacaggcccgtcgtggtgtttgggggacagcgacaggagcgggttcgcacgatcggtcgggtgaatttgggcaagtccatcagaggctcggccagcctgcgaaggttcgccgggcgaaccaccaccggggttcccagaggctcggaggccaggatccggcattgccgaagcagaaaactccacagagccgggcttgcgtcagcggaagtccgcggcagggcgtttcgttggtctaggagggtaaccacacttacaacaacaacgcccatgtcggtatattaggcccgtggtccgatcttcactcactcgcctgtctgcggacctatgcacggcgggacggcgcgcggacccgggggggctgcttgctatcacacggcccgttcgcacgttcgattttttcagccttgtttggttggctaggtatcccggataatctgacgttccggatatagggggcggggggtagtggggggtgtgtcgacaaactgccgcttcttaaaacaccggggcccgtcgctcggggtgctcgttggttggcacgcgcgacgcggcaaatggcctgtcgtaagttctgtggggtctaccgtagacccgacaagagacaggaggcgtccgtcccgccggagacaaacacggccccggccttcccggcgagcaccttttatacccccgcggaggatgcgtacctggcccccgggcccccggaaaccatccacccttcccgcccaccgtcccccggcgaggctgcgcgcctgtgtcagctgcaggagatcttggcccagatgcacagcgacgaggactaccccatcgtggacgccgcgggtgcggaggaggaagacgaggccgacgatgacgccccggatgacgtggcctacccggaggactacgcggaggggcgttttctgtccatggtttcggccgcccccctgcccggagccagcggccatcctcctgttccgggccgcgcagccccccccgacgtccggacctgcgacagcggtaaggtgggggccacggggttcaccccggaagagctcgacaccatggaccgggaggcacttcgggccatcagccgcgggtgcaagcccccttcgaccctggcaaaactggtgaccgggctgggattcgcgatccacggagcgctcatcccggggtcggaggggtgtgtctttgatagcagccacccgaactaccctcatcgggtaatcgtcaaggcggggtggtacgccagcacgagccacgaggcgcggctgctgagacgcctgaaccaccccgcgatcctacccctcctggacctgcacgtcgtttctggggtcacgtgtctggtcctccccaagtatcactgcgacctgtatacctatctgagcaagcgcccgtctccgttgggccacctacagataaccgcggtctcccggcagctcttgagcgccatcgactacgtccactgcgaaggcatcatccaccgcgatattaagaccgagaacatcttcatcaacacccccgagaacatctgtctgggggactttggggcggcgtgctttgtgcgcgggtgtcgatcgagccccttccattacgggatcgcaggcaccatcgatacaaacgcccccgaggtcctggccggggatccgtacacccaggtaatcgacatctggagcgccggcctggtgatctttgagaccgccgtccacaccgcgtccttgttctcggccccgcgcgaccccgaaaggcggccgtgcgacaaccagatcgcgcgcatcatccgacaggcccaggtacacgtcgacgagtttccgacgcacgcggaatcgcgcctcaccgcgcactaccgctcgcgggcggccgggaacaatcgtccggcgtggacccgaccggcgtggacccgctactacaagatccacacagacgtcgaatatctcatatgcaaagcccttacctttgacgcggcgctccgcccaagcgccgcggagttgctgcgcctgccgctatttcaccctaagtgaccccgctccccccggggggcgtggaggggggggctggttggatgtttttgcacaaaaagacgcggccctcgggctttggtgtttttggcaccttgccgcccggcgtcatgcacgccatcgctcccaggttgcttcttctttttgttctttctggtcttccggggacacgcggcgggtcgggtgtccccggaccaattaatccccccaacagcgatgttgttttcccgggaggttcccccgtggctcaatattgttatgcctatccccggttggacgatcccgggcccttgggttccgcggacgccgggcggcaagacctgccccggcgcgtcgtccgtcacgagcccctgggccgctcgttcctcacgggggggctggttttgctggcgccgccggtacgcggatttggcgcacccaacgcaacgtatgcggcccgtgtgacgtactaccggctcacccgcgcctgccgtcagcccatcctccttcggcagtatggagggtgtcgcggcggcgagccgccgtccccaaagacgtgcgggtcgtacacgtacacgtaccagggcggcgggcctccgacccggtacgctctcgtaaatgcttccctgctggtgccgatctgggaccgcgccgcggagacattcgagtaccagatcgaactcggcggcgagctgcacgtgggtctgttgtgggtagaggtgggcggggagggccccggccccaccgcccccccacaggcggcgcgtgcggagggcggcccgtgcgtccccccggtccccgcgggccgcccgtggcgctcggtgcccccggtatggtattccgcccccaaccccgggtttcgtggcctgcgtttccgggagcgctgtctgcccccacagacgcccgccgcccccagcgacctaccacgcgtcgcttttgctccccagagcctgctggtggggattacgggccgcacgtttattcggatggcacgacccacggaagacgtcggggtcctgccgccccattgggcccccggggccctagatgacggtccgtacgcccccttcccaccccgcccgcggtttcgacgcgccctgcggacagaccccgagggggtcgaccccgacgttcgggccccccgaaccgggcggcgcctcatggccttgaccgaggacacgtcctccgattcgcctacgtccgctccggagaagacgcccctccctgtgtcggccaccgccatggcaccctcagtcgacccaagcgcggaaccgaccgcccccgcaaccactactccccccgacgagatggccacacaagccgcaacggtcgccgttacgccggaggaaacggcagtcgcctccccgcccgcgactgcatccgtggagtcgtcgccactccccgccgcggcggcggcaacgcccggggccgggcacacgaacaccagcagcgcctccgcagcgaaaacgccccccaccacaccagcccccacgacccccccgcccacgtctacccacgcgaccccccgccccacgactccggggccccaaacaacccctcccggacccgcaaccccgggtccggtgggcgcctccgccgcgcccacggccgattcccccctcaccgcctcgccccccgctaccgcgccggggccctcggccgccaacgtttcggtcgccgcgaccaccgccacgcccggaacccggggcaccgcccgtacccccccaacggacccaaagacgcacccacacggacccgcggacgctccccccggctcgccagcccccccaccccccgaacatcgcggcggacccgaggagtttgagggcgccggggacggcgaaccccccgaggacgacgacagcgccaccggcctcgccttccgaactccgaaccccaacaaaccaccccccgcgcgccccgggcccatccgccccacgctcccgccaggaattcttgggccgctcgcccccaacacgcctcgcccccccgcccaagctcccgctaaggacatgccctcgggccccacaccccaacacatccccctgttctggttcctaacggcctcccctgctctagatatcctctttatcatcagcaccaccatccacacggcggcgttcgtttgtctggtcgccttggcagcacaactttggcgcggccgggcggggcgcaggcgatacgcgcacccgagcgtgcgttacgtatgtctgccacccgagcgggattagggggtgggggtggggggcgagaaacgatgaaggacgggaaagggaacagcgaccaaatgtcacgataagaacaataaacctgtgacgtcaatcagatatgtgagtttggttgtgttttgtgggactgggggcggggggtgggaggtatcagtgggtgacagagtcttttaaaagacgtgtcccggggccctcgagacgcgcaacttttggccacacagagaaaggcccccagacgaagtcacccgggtccccgaacaaaaacaaaaaccttgaccgccgccggggggcgtgcctgttgttttggtctcaatggatcggtatgccgttcggacctgggggattgtgggaatcctcgggtgtgctgctgttggggccgcacccaccggccccgcgtccgatacaacaaacgcgaccgcacgcctccccacgcaccccccactcatccgttccgggggctttgccgtccccctcatcgtgggggggctgtgtctcatgattctggggatggcgtgtctactcgaggtcctgcgtcgcctgggtcgcgagttggcgaggtgctgcccccacgcgggccaatttgccccatgatttttcgcctttctggccttgcccccaccccatcgccccgattgtgtgtcgggtgcccggggtacagcagctatggagcggtcggtaatataactttggttgtcgccacacgccccgtgccgggcatgggttgtgcgggaaggacgaaataatccggcgatccccaagcgtaccaactgggggggggggggggaaaagaaactaaaaacacatcaagcccacaacccatcccacaatgggggttatggcggacccaccgcaccaccatactccgattcgaccacatatgcaaccaaatcacccccagaggggaggttccatttttacgaggaggaggagtataatagagtctttgtgtttaaaacccggggtcggtgtggtgttcggtcataagctgcattgcgaacgactagtcgccgtttttcgtgtgcatcgcgtatcacggcatggggcgtttgacctccggcgtcgggacggcggccctgctagttgtcgcggtgggactccgcgtcgtctgcgccaaatacgccttagcagacccctcgcttaagatggccgatcccaatcgatttcgcgggaagaaccttccggttttggaccagctgaccgacccccccggggtgaagcgtgtttaccacattcagccgagcctggaggacccgttccagccccccagcatcccgatcactgtgtactacgcagtgctggaacgtgcctgccgcagcgtgctcctacatgccccatcggaggccccccagatcgtgcgcggggcttcggacgaggcccgaaagcacacgtacaacctgaccatcgcctggtatcgcatgggagacaattgcgctatccccatcacggttatggaatacaccgagtgcccctacaacaagtcgttgggggtctgccccatccgaacgcagccccgctggagctactatgacagctttagcgccgtcagcgaggataacctgggattcctgatgcacgcccccgccttcgagaccgcgggtacgtacctgcggctagtgaagataaacgactggacggagatcacacaatttatcctggagcaccgggcccgcgcctcctgcaagtacgctctccccctgcgcatccccccggcagcgtgcctcacctcgaaggcctaccaacagggcgtgacggtcgacagcatcgggatgctaccccgctttatccccgaaaaccagcgcaccgtcgccctatacagcttaaaaatcgccgggtggcacggccccaagcccccgtacaccagcaccctgctgccgccggagctgtccgacaccaccaacgccacgcaacccgaactcgttccggaagaccccgaggactcggccctcttagaggatcccgccgggacggtgtcttcgcagatccccccaaactggcacatcccgtcgatccaggacgtcgcgccgcaccacgcccccgccgcccccagcaacccgggcctgatcatcggcgcgctggccggcagtaccctggcggtgctggtcatcggcggtattgcgttttgggtacgccgccgcgctcagatggcccccaagcgcctacgtctcccccacatccgggatgacgacgcgcccccctcgcaccagccattgttttactagaggagtttccccgctcccgtgtacctctgggcccgtgtgggagggtggctggggtatttgggtgggacttggactccgcataaagggagtctcgaaggagggaaactaggacagttcataggccgggagcgtggggcgcgcaccgctgtcccgacgattagccaccgcgcccacagccacctcgacccgtccgatcccggtatgcccggccgctcgctgcagggcctggcgatcctgggcctgtgggtctgcgccaccggcctggtcgtccgcggccccacggtcagtctggtctcagactcactcgtggatgccggggccgtggggccccagggcttcgtggaagaggacctgcgtgttttcggggagcttcattttgtgggggcccaggtcccccacacaaactactacgacggcatcatcgagctgtttcactaccccctggggaaccactgcccccgcgttgtacacgtggtcacactgaccgcatgcccccgccgccccgccgtggcgttcaccttgtgtcgctcgacgcaccacgcccacagccccgcctatccgaccctggagctgggtctggcgcggcagccgcttctgcgggttcgaacggcaacgcgcgactatgccggtctgtatgtcctgcgcgtatgggtcggcagcgcgacgaacgccagccggtttgttttgggggtggcgctctctgccaacgggacgtttgtgtataacggctcggactacggctcctgcgatccggcgcagcttcccttttcggccccgcgcctgggaccctcgagcgtatacacccccggagcctcccgacccacccctccacggacaacgacacccccgtcctccccccgagacccgacccccgcccccggggacacagggacgcccgcgcccgcgagcggcgagatagccccgcccaattccacgcgatcggccagcgaatcgagacacaggctaaccgtagcccaggtaatccagatcgccataccggcgtccatcatcgcctttgtgtttctgggcagctgtatctgcttcatccatagatgccagcgccgatacaggcgcccccgcggccagatttacaaccccgggggcgtttcctgcgcggtcaacgaggcggccatggcccgcctcggagccgagctgcgatcccacccaaacaccccccccaaaccccgacgccgttcgtcgtcgtccacgaccatgccttccctaacgtcgatagctgaggaatcggagccaggtccagtcgtgctgctgtccgtcagtcctcggccccgcagtggcccgacggccccccaagaggtctaggtccaagcgggccgttcggcaggcccgccccaccgcccccatcgtggttatttccccccccccccaataaaccgatgttatttgcctatatgcgtgtgttggatccctttgtgatcgttcgtcattccccggatggcatgggaggcgggtaatggatgggcggggcccgggggggaggaaaaagaataaagggggtagtgtcggagaggcccgccgcgcatttaaggagtcgccgccccgactctgtgtcttcgggtgacttggtgcgccgccgtcagctagtctccgatctgccccgaccgacggctcctgccacccgaacatggctcgcggggccgggttggtgttttttgttggagtttgggtcgtatcgtgcctggcggcagcacccagaacgtcctggaaacgggtaacctcgggcgaggacgtggtgttgcttccggcgcccgcggaacgcacccgggcccacaaactactgtgggccgcggaacccctggatgcctgcggtcccctgcgcccgtcgtgggtggcgctgtggcccccccgacgggtgctcgagacggtcgtggatgcggcgtgcatgcgcgccccggaaccgctcgccatagcatacagtcccccgttccccgcgggcgacgagggactgtattcggagttggcgtggcgcgatcgcgtagccgtggtcaacgagagtctggtcatctacggggccctggagacggacagcggtctgtacaccctgtccgtggtcggcctaagcgacgaggcgcgccaagtggcgtcggtggttctggtcgtggagcccgcccctgtgccgaccccgacccccgacgactacgacgaagaagacgacgcgggcgtgagcgaacgcacgccggtcagcgttccccccccaacccccccccgtcgtccccccgtcgcccccccgacgcaccctcgtgttatccccgaggtgtcccacgtgcgcggggtaacggtccatatggagaccccggaggccattctgtttgcccccggggagacgtttgggacgaacgtctccatccacgccattgcccacgacgacggtccgtacgccatggacgtcgtctggatgcggtttgacgtgccgtcctcgtgcgccgagatgcggatctacgaagcttgtctgtatcacccgcagcttccagagtgtctatctccggccgacgcgccgtgcgccgtaagttcctgggcgtaccgcctggcggtccgcagctacgccggctgttccaggactacgcccccgccgcgatgttttgccgaggctcgcatggaaccggtcccggggttggcgtggctggcctccaccgtcaatctggaattccagcacgcctccccccagcacgccggcctctacctgtgcgtggtgtacgtggacgatcatatccacgcctggggccacatgaccatcagcaccgcggcgcagtaccggaacgcggtggtggaacagcacctcccccagcgccagcccgagcccgtcgagcccacccgcccgcacgtgagagccccccatcccgcgccctccgcgcgcggcccgctgcgcctcggggcggtgctgggggcggccctgttgctggccgccctcgggctgtccgcgtgggcgtgcatgacctgctggcgcaggcgctcctggcgggcggttaaaagccgggcctcggcgacgggccccacttacattcgcgtggcggacagcgagctgtacgcggactggagttcggacagcgagggggagcgcgacgggtccctgtggcaggaccctccggagagacccgactctccctccacaaatggatccggctttgagatcttatcaccaacggctccgtctgtatacccccatagcgaggggcgtaaatctcgccgcccgctcaccacctttggttcgggaagcccgggccgtcgtcactcccaggcctcctatccgtccgtcctctggtaaggcgtcttccgacgacgcggacgtcggcgatgaactgattgccatcgcggacgcacgcggggacccgccagagaccctgccccccggcgcgggcggcgccgcgcccgcgtgccgcagaccacctcgcggcggctcccccgcggcctttcccgtggccctccacgccgtggacgccccctcccaattcgtcacctggctcgccgtgcgctggctgcggggggcggtgggtctcggggccgtcctgtgcgggattgcgttttacgtgacgtcaatcgcccgaggcgcataaaggtccggcggccagccccgccgcagctcataaaaatcgtgagtcacggcaaccgcaccttcgcctccggccctccgccagcgcccttccgcgtccgcgatgacctcccggcccgccgaccaagactcggtgcgttccagcgcgtcggtgccgctttaccccgcggcctcgcccgtcccggcagaagcctactactcggaaagcgaagacgaggccgccaacgacttcctcgtgcgcatgggccgccagcagtcggtcctaaggcgccgacggcggcgcacgcggtgcgtcgggctggttatcgcctgtctcgtcgtggccctcctatctggagggttcggggcacttttggtgtggctgctccgctaaatgacgcctcgatgtatggcgccttcttcgcccccacccctcgccgcgacccacgtccgtatgttaattgcaataaagtggttgattgtcattacggtctactaggttgtcttttttttttgggggggggggaggaaatgcagaaaagggtaagaaattctcggaatttcacccccgggggggggcaagtgcagtaacccagttcctcagtgtttgggaaatctattgaactctcccggctcctccgtgttagggaagtctcttggggaaatctattgacctctcgccccccccccccaggaggggggcagtgcagtaccccagttcctccgtgctggggaaatctctctgccgggtacgggctccagacgaaggacccatacatttccccatccgcaccccacatctggcgttctagagtcacgacgcatttgcccccgtccccgcagcaacacacaaagcgatttcaattttcacgattttattattaattacaccaaccaccctgtccccgggacgtggtcaggaccgggggtccgcacccaaacgcacgaaacaaatgctggcagtgtgccgaatataaccccgcgtaggaacacgtcgacgcgtgcgccaaacagcaccagaaggcgcatgccatcagcaggtcgtgcatatggcgatgtgtttggacgcagggcgcagccgcggcgataaaattcatggcggccgtccgccagggccacagcggcgaggactccctgttggcccgaagccattgggtatgaaccagctgcgcctcctgtccgaccctggctcccgccagcgggggcggtgggtcgtgggtgttgagagcacacaggcgggacacctcgatcaccgtccgaaaaaaggcccggtggtccgcgggcagcatctgcaggtgcgccagggcctgggcgttgagagggtacaactcggagccgggggactccgggggccggtccgcgcggtgccgcgagttggcacgctttggggcccgggtgtcggacgcgggcgcgttatggatcccgacgcggggcagaacgtacgtgcgttggcgcggcgatgaggggtccgggctgccgaggggggcgtaggggaccgggctaggcaagcccgcgggttgcgcggggttcccgtgggggtctaggctccctgggcacccgtgggggtcgtgggggtcgcgggtccctgggtatgcgcgggaccctgggttctctgggagatcgtggaactcgcggttccctgggctctcggggaacccggggctccctggggacacgtggtgccctgggaattcttgatggtcggacggcttcagatggcttcgggatcgagagggccgcacagactcgtagtagacccgaatctccacgtttccccgccgccggatcatggtcgccgccccggtgcgggggcccgtcggtcggaagcgagtgcccttcaagcgtgtccgctcctctgggctgcatgccgtcggatggggtgccttttaaggaaaggtctcggctgcccgccccaaccggggtttgggggtgggccggggaaaccccggatgccatgggggggtcacaccctaagcgccggcgcgctggttgggtgggggtagaggggagtccccggtcgacgagatcgtataagctgggtaccgagctcgaattcatcgatgatatcagatcgatccccatggtgtcccgtccacgaaggcggcgcccggcctgcgagaaagcgcggatgttgggatcggggccccgtccccccgttccccggcccgtccccccgtccccccggcccgtccccccggcccgtccccccggcccggccccccgggtcaccgtacctgcgataaggctgcagtgggtggatgggtcctcgcggtacgtacagggtgggggggggggggggagggaaaggcagaacgaaaaggaaccgatgcgcccgcgtctctgtatccgatccgatccgggtgcgtcggtgccccgctcgccgccggcgtctctgtctcgctgtggcccccttcgcgatgccgccgctgccgtcccggtctccgccgcgcagccggtgtgcccctggtgcggcggcgaccgggacgccggccctttatgtgcgcgaggaacggcccgccccccgtccgggcccgcctcggggcggagcccgcgggatgacgcgggccccgggcagggcgccagtgctcgcactttgccctaataatatatatactattaggacgaagtgcgaacgcttcgcgttctcacttcttttaccctgcggccccgccccctttggggcggagcccgcgggatgacgcgggccccgggcagggcgccagcgctcgcactttgccctaataatatatatactattaggacgaagtgcgaacgcttcgcgttctcacttcttttaccctgcggccccgccccctttggggcggagccgcccgcggaccaacggggcgacctcgccggcccctttggggccggcgggggccaacgggagcgcggggccggcatctcattaccacgaacccggaagggcaggggagcgagcccgcccgcgacgagggtctcattagcatcgcgggcggaagcggaagccgcccgcgccgggcgctaatgagatgccgcgcgggcggagccggcggcggcgcgaccaacgggccgccgccacggacgcggacgcgcgggcgtcggggcggggccgcgcataatgcggttccacctgggggcggaaccccggcgagccggggcgcggcggcgtcgatcgctcctcctccgcgtcctcctcctttccccccgccccgcgcgccccgaggactatatcagccaggcgacggggcgatcgtccacacggagcgcggctaccgacgcggccgccaggatctacccgatcggcgcggagaggcgaaaagacacaggcacacgcacgcaccgcacgggggggagagagactgccaaccacccccccccactgccgcccctgaagaagaagaagaagacccccccccgcacaccccggtcggaggcgatgtcggcggagcagcggaagaagaagaagacgacgacgacgacgcagggccgcggggccgaggtcgcgatggcggacgaggacgggggacgtctccgggccgcggcggagacgaccggcggccccggatctccggatccagccgacggaccgccgcccaccccgaacccggaccgtcgccccgccgcgcggcccgggttcgggtggcacggtgggccggaggagaacgaagacgaggccgacgacgccgccgccgatgccgatgccgacgaggcggccccggcgtccggggaggccgtcgacgagcctgccgcggacggcgtcgtctcgccgcggcagctggccctgctggcctcgatggtggacgaggccgttcgcacgatcccgtcgccccccccggagcgcgacggcgcggaagaagaagcggcccgctcgccttctccgccgcggaccccctccatgcgcgccgattatggcgaggagaacgacgacgacgacgacgacgacgatgacgacgaccgcgacgcgggccgctgggtccgcggaccggagacgacgtccgcggtccgcggggcgtacccggaccccatggccagcctgtcgccgcgacccccggcgccccgccgacaccaccaccaccaccaccaccgccgccggcgcgccccccgccggcgctcggccgcctctgactcatcaaaatccggatcctcgtcgtcggcgtcctccgcctcctcctccgcctcctcctcctcgtctgcatccgcctcctcgtctgacgacgacgacgacgacgacgccgcccgcgcccccgccagcgccgcagaccacgccgcgggcgggaccctcggcgcggacgacgaggaggcgggggtgcccgcgagggccccgggggcggcgccccggccgagcccgcccagggccgagcccgccccggcccggacccccgcggcgaccgcgggccgcctggagcgccgccgggcccgcgcggcggtggccggccgcgacgccacgggccgcttcacggccgggcggccccggcgggtcgagctggacgccgacgcggcctccggcgccttctacgcgcgctaccgcgacgggtacgtcagcggggagccgtggcccggggccggccccccgcccccggggcgcgtgctgtacggcgggctgggcgacagccgccccggcctctggggggcgcccgaggcggaggaggcgcgggcccggttcgaggcctcgggcgccccggcgcccgtgtgggcgcccgagctgggcgacgcggcgcagcagtacgccctgatcacgcggctgctgtacacgccggacgcggaggcgatggggtggctccagaacccgcgcgtggcgcccggggacgtggcgctggaccaggcctgcttccggatctcgggcgcggcgcgcaacagcagctccttcatctccggcagcgtggcgcgggccgtgccccacctggggtacgccatggcggcgggccgcttcggctggggcctggcgcacgtggcggccgccgtggccatgagccgccgctacgaccgcgcgcagaagggcttcctgctgaccagcctgcgccgcgcctacgcgcccctgctggcgcgcgagaacgcggcgctgaccggggcgcgaacccccgacgacggcggcgacgccaaccgccacgacggcgacgacgcccgcgggaagcccgccgccgccgccgccccgttgccgtcggcggcggcgtcgccggccgacgagcgcgcggtgcccgccggctacggcgccgcgggggtgctcgccgccctggggcgcctgagcgccgcgcccgcctccgcgccggccggggccgacgacgacgacgacgacgacggcgccggcggtggtggcggcggccggcgcgcggaggcgggccgcgtggccgtggagtgcctggccgcctgccgcgggatcctggaggcgctggcggagggcttcgacggcgacctggcggccgtgccggggctggccggagcccggcccgccgcgcccccgcgcccggggcccgcgggcgcggccgccccgccgcacgccgacgcgccccgcctgcgcgcctggctgcgcgagctgcggttcgtgcgcgacgcgctggtgctgatgcgcctgcgcggggacctgcgcgtggccggcggcagcgaggccgccgtggccgccgtgcgcgccgtgagcctggtcgccggggccctgggcccggcgctgccgcggagcccgcgcctgctgagctccgccgccgccgccgccgcggacctgctcttccagaaccagagcctgcgccccctgctggccgacaccgtcgccgcggccgactcgctcgccgcgcccgcctccgcgccgcgggaggcgcgcaagcgcaagagccccgccccggccagggcgccgccgggcggcgccccgcgccccccgaagaagagccgcgcggacgccccccgccccgcggccgcccctcccgcgggggccgcgccccccgccccgccgacgccgccgccgcggccgccgcgccccgcggcgctgacccgccggcccgccgagggccccgacccgcagggcggctggcgccgccagccgccggggcccagccacacgccggcgccctcggccgccgccctggaggcctactgcgccccgcgggccgtggccgagctcacggaccacccgctcttccccgcgccgtggcgcccggccctcatgttcgacccgcgcgcgctggcctcgctggccgcgcgctgcgccgccccgccccccggcggcgcgcccgccgccttcggcccgctgcgcgcctcgggcccgctgcgccgcgcggcggcctggatgcgccaggtgcccgacccggaggacgtgcgcgtggtgatcctctactcgccgctgccgggcgaggacctggccgcgggccgcgccgggggcgggccccccccggagtggtccgccgagcgcggcgggctgtcctgcctgctggcggccctgggcaaccggctctgcgggcccgccacggccgcctgggcgggcaactggaccggcgcccccgacgtctcggcgctgggcgcgcagggcgtgctgctgctgtccacgcgggacctggccttcgccggcgccgtggagttcctggggctgctggccggcgcctgcgaccgccgcctcatcgtcgtcaacgccgtgcgcgccgcggactggcccgccgacgggcccgtggtctcgcggcagcacgcctacctggcctgcgaggtgctgcccgccgtgcagtgcgccgtgcgctggccggcggcgcgggacctgcgccgcaccgtgctggcctccggccgcgtgttcgggccgggggtcttcgcgcgcgtggaggccgcgcacgcgcgcctgtaccccgacgcgccgccgctgcgcctctgccgcggggccaacgtgcggtaccgcgtgcgcacgcgcttcggccccgacacgctggtgcccatgtccccgcgcgagtaccgccgcgccgtgctcccggcgctggacggccgggccgccgcctcgggcgcgggcgacgccatggcgcccggcgcgccggacttctgcgaggacgaggcgcactcgcaccgcgcctgcgcgcgctggggcctgggcgcgccgctgcggcccgtctacgtggcgctggggcgcgacgccgtgcgcggcggcccggcggagctgcgcgggccgcggcgggagttctgcgcgcgggcgctgctcgagcccgacggcgacgcgcccccgctggtgctgcgcgacgacgcggacgcgggcccgcccccgcagatacgctgggcgtcggccgcgggccgcgcggggacggtgctggccgcggcgggcggcggcgtggaggtggtggggaccgccgcggggctggccacgccgccgaggcgcgagcccgtggacatggacgcggagctggaggacgacgacgacggactgtttggggagtgacgggggggaaacttccgggagcgggggaggggggagatggggagagggggaaggaatcgggcgtctgtgcgcctttaagacagacgcggcgatggccgcgcgcgtgtgtgagaaataaagaacgagacagacgaaaacgtaccgccttgtgtggtttattcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggtgggcggcacgtctcccgcgcccgcggggggtctggggctctgacctgagtgcaggttacgaaggtcaggtggcccgagcccccccgcaggagcgggagggaaggcacggggcgcgggagggaggggctgctgcgagctcggggccgcgggcgcggggggaggggcgggggaagcccccggggcggggcgcgggggaggcggccgcgggggaggcggccgcgggaccgcagccccgtggcgcgcgggggggaggggctgccgcgagctcggcgggatggaggggagggagggggtggcggggaaccgtgtgcgggcgggcgggtgcttggtgcaactgtctggtctgcgagggcgagcggtggtgcgactggcgtcttcgggggggcggggagcttgggagtgtgtggtggtctgcggcacagcctgctagtccccgtcttgccgcgcgggggcgggcgcgggaaaaaagccgcgcgggggcgcccgcgggaaggcagccccgcggcgcgcggggggaggggcggcgcccgcgggggagcggccggctccgggggagggacggggaagggggcgcgcggggctgccctgccgcccgcccgccgccgccgcccgccttcgcgcccccccccaaaaaacaccccccccgggggttgactccccgggggaaaagaggcggggcggg

SEQ ID NO: 19 - DNA, 154697 bp, synthetic construct
  source 1..154697: mol_type = other DNA
agtccccgtcttgccgcgcgggggcgggcgcgggaaaaaagccgcgcgggggcgcccgcgggaaggcagccccgcggcgcgcggggggaggggcggcgcccgcgggggagcggccggctccgggggagggacggggaagggggcgcgcggggctgccctgccgcccgcccgccgccgccgcccgccttcgcgcccccccccaaaaaacaccccccccgggggttgactccccgggggaaaagaggcggggcgggagtccccgtcctgccgccgccccttaagagggcccgcaacacggcccgggctgcgcacgccagccgggacgggtgagttcgctaggcaagcacggactggcggttacacggataacctggttctttccgcctcagaagccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagcatttaggtgacactatagaatagggccctctagctcgagtcagctgaagatccagctctgcaggatggtgatgatggcgttggccatctcctcctgctcgtcctcgctggcggtggtcttgatccgcttcatccactccttcatccgcttggccttctcggcctcgtccttctggtcgccgctctcgaacagccgggcgatctcctccaggatcagctcgaagttgaaggcgtagtcctccagcttctcctcggcgggggggctgttggtcttcacgatgttcaggatcatcagggcgtcgtacagggcgtgctcggcgtgcagctggatcttcttcttgggcatgtggctgccccggggcaccaggccgctgctgtggtggtggtggtggtggctgctgcccatgctgttggtcaccagggccaggctcagggcgatgcagctcagcagctgcatccggtacatggatccagcttgggtctccctatagtgagtcgtattaatttcgataagccagtaagcagtgggttctctagttagccagagagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacgcgtatatctggcccgtacatcgatcatcgatgaattcgagctcggtacccggggatcctctagaccggcttcccggtatggtaattagaaacttttaataggcggtcccggccgccatccccgcgcatggtaattagcaacttttaatgggccggcgttcccgctcgcggtaattagcagcttttaacgggccgccattcccgcttatggtaattaaaaacgttcggacggcccctcgctccccgcgtaattactccctcggggttccgggttatgctgattactttcttggcagaacacgcagagcctcgcgcgccgccgggtgggtgggctgatcggcccctattggtcccctgggcttcctagtatgctaatgaatttctccccgggggcgggcaccactcagggccgcgccggcggggcgccggggggactcccatctgcgtcggcggggggcggcgcatgctaatggggttcttggagtacacccggttggtccccggggacggggccgccccgagagggggggattccctccctccgcccccgccggggcgcgcggctattgggggaatcgtaaatgccgcccctttgggggagtggataggcgccgggtataaggcagccccgtgtgacggtcgggccgcattcgcaccccggcactgcgagcgacggagcggcggcccggcgggaggaggagacccggagagacagagactaaaacccggcaagagagagaccgcgggccgccgtctcgagtctaccctaccccggctcatggaaccccggcccggcacgagctcccgggcggaccccggccccgagcggccgccgcggcagacccccggcacggtgagagggcgacccccgggtctcaggcccccccttttccccggaccacccggctgcgggttgggggtggtcgcgggcggtgggctcgggggcggggacgcttgacggggccgacccccggcccgcttaagcggtcgggggacccccgtgggccgtgcgccgccccccgaccctctgggggggcgagggaggcagggaggagcccgagagcgggggacagggggggagacgaggggtcggaatccaaaggacgcagaccacctttggttacggacccctttctcccccccttccgaacaaaaagcagcgggcggggggccggggtgagggagggacacgggggacacggcgcgggggtcccgcctcacgccccgcgccctctaaatcccccccgttgctttgtcaagcagcccgccgccccgcacgcctgggggatgctcaacgacatgcagtggctcgccagcagcgactcggaggaggagaccgaggtgggaatctctgacgacgaccttcaccgcgactccacctccgaggcgggcagcacggacacggagatgttcgaggcgggcctgatggacgcggccacgcccccggcccggcccccggccgagcgccagggcagccccacgcccgccgacgcgcagggatcctgcgggggtgggcccgtgggtgaggaggaagcggaagcgggaggggggggcgacgtgtgcgccgtgtgcacggacgagatcgccccgcccctgcgctgccagagttttccctgcctgcaccccttctgcatcccgtgcatgaagacctggattccgttgcgcaacacgtgtcccctgtgcaacaccccggtggcgtacctgatagtgggcgtgaccgccagcgggtcgttcagcaccatcccgatagtgaacgacccccggacccgcgtggaggccgaggcggccgtgcgggccggcacggccgtggactttatctggacgggcaaccagcggacggccccgcgctccctgtcgctggggggacacacggtccgcgccctgtcgcccacccccccgtggcccggcacggacgacgaggacgatgacctggccgacggtgagggcgggcgggggtcgggcgggggtcgggcgggggtcgggcgggggtcgggcgggggtcgggcgggggtcgggcgggggtcgggcgggggtcgggcgggggtcgggcgggggtcgggcgggggtcgggcgggggtcgggcactaaccgggggctcccgtctctgtctccctctgcagtggactacgtcccgcccgccccccgaagagcgccccggcgcgggggcggcggtgcgggggcgacccgcggaacctcccagcccgccgcgacccgaccggcgccccctggcgccccgcggagcagcagcagcggcggcgccccgttgcgggcgggggtgggatctgggtctgggggcggccctgccgtcgcggccgtcgtgccgagagtggcctctcttccccctgcggccggcggggggcgcgcgcaggcgcggcgggtgggcgaagacgccgcggcggcggagggcaggacgccccccgcgggacagccccgcgcggcccaggagccccccatagtcatcagcgactctcccccgccgtctccgcgccgccccgcgggccccgggccgctctcctttttctcctcctcctccgcgcaggtgtcctcgggccccggggggggaggtctgccacagtcgtcggggcgcgcggcgcgcccccgcgcggccgtcgccccgcgcgtccggagtccgccccgcgccgccgccgcccccgtggtgtctgcgagcgcggacgcggccgggcccgcgccgcccgccgtgccggtggacgcgcaccgcgcgccccggtcgcgcatgacccaggctcagaccgacacccaagcacagagtctgggccgggcaggcgcgaccgacgcgcgcgggtcgggagggccgggcgcggagggaggacccggggtcccccgcggcaccaacacccccggtgccgccccccacgccgcggagggggcggcggcccgcccccggaagaggcgcgggtcggactcgggccctgcggcctcgtcctccgcctcttcctccgccgccccgcgctcgcccctcgccccccagggggtgggggccaagagggcggcgccgcgccgggccccggactcggactcgggcgaccgcggccacgggccgctcgccccggcgtccgcgggcgccgcgcccccgtcggcgtctccgtcgtcccaggccgcggtcgccgccgccgcctcctcttcctcctccgccgcctcctcttcctcctccgccgcctcctcttcctcctccgccgcctcctcttcctcctccgccgcctcttcctcctccgccgcctcctcttcctcctcctcctcctccgcctcttcctctgcgggcggggctggtgggagcgtcgcgtccgcgtccggcgctggggagagacgagaaacctccctcggcccccgcgctgctgcgccgcgggggccgaggaagtgtgccaggaagacgcgccacgcggagggcggccccgagcccggggcccgcgacccggcgcccggcctcacgcgctacctgcccatcgcgggggtctcgagcgtcgtggccctggcgccttacgtgaacaagacggtcacgggggactgcctgcccgtcctggacatggagacgggccacataggggcctacgtggtcctcgtggaccagacggggaacgtggcggacctgctgcgggccgcggcccccgcgtggagccgccgcaccctgctccccgagcacgcgcgcaactgcgtgaggccccccgactacccgacgccccccgcgtcggagtggaacagcctctggatgaccccggtgggcaacatgctctttgaccagggcaccctggtgggcgcgctggacttccacggcctccggtcgcgccacccgtggtctcgggagcagggcgcgcccgcgccggccggcgacgcccccgcgggccacggggagtagggggagctaacactcggcttgctgcccaaagggaagccgccccccaccggaccaccggccgaggcgcctcgggggcagggggaggtgggggggaaagacggggaggagacaggaagtgggggtgggagtggggggggacggacacggccccgaacagcaacacacaccagcattttgttatggactttctggccttgttgaaaacttgaggaaaaaaaactttatatttataaaaattttacaataaagttttgtgatgcttttgacacactttgttgttggcctttgatgcagctcccccgcgcaggggggccggggatggggggggggaaagggaggaggaggagggggggcgggcacgagaagccgcccccacccccgaggcctgttggtctttatgatagaacagagccggggcccggcctgcgttctggctccctgtcttggtgggtgggcgggctggctggcgggtaaaaaaagagtgtgtccgtgttgacagggaggggggcccgatcgtgcagagcacgcacgtctggccggccagaccctgggggtggtgggcaggagtgggagggcgcctggctcggggagggaggagggggggggtcagccgcaccaccggcgcgaagccaggggccagggaactttgatagagagggggggaaagtggggcgggggcgagggcggttgaatcacaacgcatgcacgccctctgcccccggggacgggtgggaggaaggaggagggagaagagaagacccgaggcatgcacccgcacttacgcccgtgcccacccccgccccggcgcccaccccgcccgcacacctgcccgccacgcccgcccctcctcaccctggctgggagaaaggaggaggagcaggaagaggagacccgaggcatgcaaccgcactcaccccaccccgcccgcacacctgcccgccacgcccgcccctccttaccctggctgcggggagactcccatcggggcgagggggctcgcgcgttcgcaacaccacaccacaccacacggcccaccacaacacggcccaccacgacacaacacgacacgacgcgttttgcggggcatgcaagtcgacacaccgcgcgcgtgcctacctttccctagcggccccggcccccggcccgtttccttccgccaccactaccaccacccccccgcccgcgcccacgcggtagaggaaggggacgggcgccacacccacggctgtggctgggcacgcgcctttggggttgttgggggggggtgaccggcgcgtgggggcggtgggcgtatgggcccgacccgcgcctgccccccctgggaacgacgcccccggacgacaccacgggggggggaaacgggggtgggtggaagggaagaggaaggagaaagggggggtggatccgaacacgccggatccgcgaaaataataacaaaacaaacaaaaacagaaacaaaaacaaaaacacctagaaaaaaaggatacgggttggctcgcgggcggtgcggctgacctgcctgccctttctgggacccccgcctcgtgtttcttgaaagggggaggaagaacagttctcccccaacccctgctctcttctctcttccgcccgccccccccccctctcccgccgcctcagcagaagctcacctgtacgaccctaaacctacctgcgagaacgcgcggcgttcgaggggcgcgctctctcacacgagacacacgcaggcgccccccccccccggagcctgggtcccccggcggacggctcacgcggcgcggcgtctcggtgggacgcgggcagagggcggcggcggcgggggggggggggaaatgtgaggagagcgagacagagagagagaaggaagagggaaggggcgcggcgggacgggggaagacgaggagaagggaaggggcgagggtcgggcccgggagcggggcggccgggagggagaagaaacggaacgcggaaacgccgccggcgcggcccggggccccggggcccccgcgctccgccgggggcccgggccggaccgccgggcgggggacgccttccgcccggcgccgggcggctacccgggacccccggccgggaatcgaaaaaagcctccgggggcccctttcgcgcctttcgcgaacgcgcggcgccggagggggcggccgccgaggtgcgggggcccctccggccggggcgcacctcggcggccaagccccggcccgcccgggggtccccgaggcagaggcggaccctcggaggcgcggaagaagacgggaggcgggggaaaaaagggggaagagagggggaggtagggaggggagaggagaagggcgcgccggtgcgcggagcagccttccttctccggagtccctctcgatcggcggcgggcccctgcgttcgttgctgccgcgcccccggttttataaagacagggatgacgcagcagaaatgcccacagcaacacgcgggcggggctcgggctctccggcggcttaatggatctccgggcacggcgcccgcaaccgcagagcactcagctggcgcgcccccccccaacgtgggagtgtttaatggaagggcgtggggccggccgccggatgcccgcgggggcctaatgcggcgggaggcgtgggccgctggcgccgcggcccgtctgctggcccgcggcccgtctgctggcccgcggccacgtaaacaatgacacaggggttctctccgccgcggccggcgcggggcgttgccggcccggcccggccccggagcccgcggcgctgctcggctgcggccgcgggctccgggggctccgcactctgcccggctcgccccgtcccccctcttgctgcttttccgcgcgcctctctttcccgttgctttccctctccccccccccccctctctctctctctctctctctctccgccatcctcccgcccggccgcccactccccgctcggcctctccggctgcggtgcttgggtctccttcgtcgggcggcggggggggggcgtcgggactcgcggagggccggagaatggaaggcgaggggatgcaggaggaggatcgggactccccatcttctgcccttccatcctccgtttttccgctttccaccgccgccgccaccacccccccttccttcgcccgcccgcctcgccccggacccctcccccccgtgttccccccatcgttcaccaccacgccccccaccgcgccttggctgtttggggggtggcggcggtggtcggcgtgctgccggaggctgcgggcgcggggtaggtgggtgggcgggtggtgggggggggcccggctgcgtctcgccgcgatcccgccggtggggcgcggcggcggtcggggtggggggagagtgtcgtgggtgtgttttcgtgtcccccaccaccactcccaccccgaccgccgccgcgcccgcgtttctgccgcccgcgcgctcctgtgtggaccccggggtgggcggcggggggggggtgccgtgggtgtggcggcggggcgcgggccggggccggggctcgctggtccgccgaagtaaagaaaagatcgccaccgtgtgttcgtctgtgtgttctgcgcggcgccggggcccccctgccgggcggggcggtggggcggggccggggtcgcggcggggaaggaaggaaagaccccggaagcgccgggagggggcgccggcgcgacgcgggcggccgggcgggggcgcgcggcggccgggcgggggcgcgcggcggccgggcgggggcgcgcggcggccgggcgggggcgcgcggcggccgggcgggggcgcgcggcggccgggcgggggcgcgcggcggccgggcgggggcgcgctttccccgcgtcgcccctcgggttcccaagacctatcacgtgtgcgcaggggaggggaggacgcgggggaggggaggacgcgggggaggggaggacgcgggggatatataaagcggtagaaagcgcgggaatgggcatattggacccgcgtgattcggttgctcgcggttgtcttgtttggacgttttttatgcgggaacaagggggcttaccggttacactgtccgctcgctatggggttcgtctgtctgtttgggcttgtcgttatgggagcctggggggcgtggggtgggtcacaggcaaccgaatatgttcttcgtagtgttattgccaaagaggtgggggacatactaagagtgccttgcatgcggacccccgcggacgatgtttcttggcgctacgaggccccgtccgttattgactatgcccgcatagacggaatatttcttcgctatcactgcccggggttggacacgtttttgtgggataggcacgcccagagggcgtatctggttaacccctttctctttgcggcgggatttttggaggacttgagtcactctgtgtttccggccgacacccaggaaacaacgacgcgccgggccctttataaagagatacgcgatgcgttgggcagtcgaaaacaggccgtcagccacgcacccgtcagggccgggtgtgtaaactttgactactcacgcactcgccgctgcgtcgggcgacgcgatttacggcctgccaacaccacgtcaacgtgggaaccgcctgtgtcgtcggacgatgaagcgagctcgcagtcgaagcccctcgccacccagccgcccgtcctcgccctttcgaacgcccccccacggcgggtctccccgacgcgaggtcggcgccggcatactcgcctccgacgcaactagccacgtctgcatcgcaagccaccctgggtcgggagcaggacagccgacccgtctagcggccgggtcggctgtccagcgtcgtcgccctagaggctgtccgccgggcgtgatgttttccgcatctacgacccccgaacagcccctggggctgtcgggcgatgcgacgccgcccctgccgacttccgtgcccctggactgggccgcgtttcggcgcgcgtttctgatcgacgacgcctggcggcccctgttggagccggagctcgcgaaccccctaaccgcgcgcctcctcgcggagtatgaccgtcggtgccagaccgaagaggtgctgccgccgcgggaggatgtgttctcctggacgcggtattgtacccccgacgacgtgcgcgtggttatcatcgggcaggacccgtaccaccatcccggccaggcgcacggcctggcgtttagcgtgcgtgcggatgtgccggtgcctccgagtctacggaacgtgctggcggcggttaaaaattgttaccccgacgcgcgcatgagcggccgcggctgcctggaaaagtgggctcgcgacggcgtgctgttgttgaacacgaccctgaccgtcaagcgcggggcggcggcgtcccactccaagcttggatgggaccgttttgtgggcggggtggtccgacggctggccgcgcgccgcccgggcctggtctttatgctctggggcgcccatgcccagaacgcgatcaggcccgaccctcgccaacactacgtcctcaagttttctcacccgtcgcccctctccaaggtcccgtttgggacgtgccagcatttcctcgccgcgaatcgctacctcgaaacccgggacattatgccgatcgactggtcggtataagatgccgacatccggggtcttgatttacgagggggcaattaataaagactgttgatggttaaatctcgggtctcataccggtccgtgatgtcgggcgtgggggaagagagggtcccctctgcgtttactatccttgcctcgtggggctggacgtttgcaccccagaaccatgatcctggcgcgtcgccgaatacgacgcccatagagtcgattgcggggaccgcaccggacgcgcacgtggggcctctcgacggagagccggaccgggatgcgatctccccgcttacgtcgagcgtggccggcgacccgccgggggcggacggcccctacgtcacctttgatactctgtttatggtatcttcgatcgacgaactggggcgccgccagctcacggatacgatccgtaaggacctgcggctgtcgctggccaagttcagcatcgcgtgtaccaagacctcgtcgttttcggggacggccgcgcgccagcgcaagcgcggagcaccgccgcaacgcacatgcgtaccacgcagcaacaagagcctccagatgttcgttttgtgcaagcgcgccaacgccgcgcaggtgcgcgagcagctgcgggcggttattcggtcgcgcaagccgcgcaagtattacacgcggtcctcggatgggcggctctgcccggccgtccccgtgtttgtacacgagtttgtttcgtccgaacccatgcgcctccatcgagataacgtcatgctgtctacggaaccagactaagcacccccgccgtcccctttcttttccccctacccttccccccgttactgatgtgttgtgacgtttcaataaataacacgtagcttattttgttggatgatggattgattgattttattgaccgttcgttcgcccggcggtgccgtcgccgcgcgcagagggaatatgcaagcgggcggggtggggaggaaagaaggtttcaggttccgggggttgggtctgcgtcgtccagggtggggctgatctgaatttcccgcagaacctcgaccagtaggtctgttgtgtttgctgggaactcgcccgccgttggggatacgggggcggggggtgtggtcgggcggacgtccaggggtgcgttatcgcacccccgcgccgcctcgggggccgtcccgtagatcgttgcggtgatgtagatggtgtccggggtccacaccaccgtcaggatgccggccgtcgcactccggacgctttcgccgtgcgatgagctgacccaggagtcaaaggggtacgcgtacatatgggcgtcccaccagcgctccagcctctgggtactagcgcgtcctataaagcggtatgcgcaaaattcggcacgacagtcgataatcaccagcagcccgatgggggtgtgttgtatcaccacgcctccgcggggcaggcggtcctggcgcgctcgaccccgcgtcagaaccgcgcgcgtccctgactcaaacacgtgcaccacctgtgccgcgtccggcagcgcgctcgttagcgacgccctggggtgatgtaggctgtacgcgatggtcgtctgggggttccccatgtctcgggggggtgggggtgaatgtcacccggcccgggtgcggtgggaacgcgagggaatggagggttaatagacaatgaccacattcggatcgcgtagagcagatagtatgtgctcgctaatgacgtcatcgcgttcgtggcgctcccggagcgggtttagattcatgtgcaggaactcggatgaggtggtgcgggacatggctacgtacgcgctgtttaggcgcaggtttccgggcgtgaagcatatggcgaccttgtccagactgagcccctgggagcgcgtgatggtcatcgcgagtttggagctgatgccgtagtcggcgttgatggccatggccagctccgtggagtcgatcgactcgacaaactcactgatgttggtattgacgacagacatgaagccgtgctggtcccgcaggacgatgtagggcaggggggactcctccaagaactcggccacgccggccgtcgcgtgccgccgccgcagctcctccgcgaacgcgaacacccgggtgtacgtgtaccccatcagcgtgtagttgtccgtctgcagggccacggacatcagccccccgcgcggcgagccggtcagcagctcgcagccccggaaaatgacattgtccacgtaggtgctgaagggggcgctctcaaacacctccccgaagagctcccgtaggataaggtatcgccccagaaaggccctcttcaggagcccaaactgggcgtggacggccgcggtggtctcaggctcttcgagggcgtagtggcagtagaacacgtccagctgctgttcgtccagcccggcgaagataacgtcaaggtcgtcgtcggggaagtcgtccgggcccccgtcccgcgggcccaggtgcttaaaattgaacgcacgctcccccggagagcggtcgctggtgtcggcggccctggttgccgatgcgccggcggcgtcccggcgtagcgacaggagttctgccgtcagctcccctaggcggccgtaggccagggtcctctgggtcgcgtccaggccggggcgctggagaaagttgtaaaagtgaatcagcccgccgaacatgagccgcgacaggaaccggtaggcgaactccaccgaggtctccccctgggtcttcacgaagctgtcgtcgcgcagcacagcctcgaaggtccgaaacgtcccgtcgaacccaaacaccatctttcggaggcgcgcggtcaccgcgacctggctgttgaggacgtacgtgatgtcgttccgggccacgactagctgttgcttgctgtgcacctcacagcgcacgtgccccgcgtcctggtcctgactctgggagtagttggtgatgcgactggcgttggccgtgatccacttttccatggtcagcgtgggttgctgcgtgagccgtcgatactcgtcaaactctttgaccgacacaaacgtgagcacggggagggtaaacacaacaaactccccctcgcgagtcacctttaggtaggcgtggagcttggccatgtacgcgctgacctccttgtgggacgagaacagccgcgtccaccccggaaggttggccgggttggtgatgtaactttccgggacgacaaagcggtccacaaactgcatgtgctcctcggtgatgggaaggccgtactccagcaccttcatgaggttcccgaactcgtgctccacacatcgcttgttgttaatgaaaatggcccagctgtgcgagaggcgcgtgtactcgcgtagggtgcggttgcagatgaggtacgtgagcacgttttcgctctgccggacggagcatcgcagtttttggtgttcgaaggtggactccagcgaggccgtctgggtcggcgaccccacgcacaccagcaccggccgcaggcggcccgcgtactggggggtgtggtacagggcgttaatcatccaccagcaatacaccacggtcgtgagtaggtgccgccccaggagcccggcctcgtcgatgacgataatgttgctgcgggtgaaagccggcagcgccccgtgtgtgaccgaggccaggcgcgtgagggcaccctggcccagccccaaagtctgctctagggcggtgagggcgtggaactcgtttcgcgcgtcttcgcccccgtgcgccgccagggcccgcttggtgatgtcgaggatcacctcccagtagtacgtcaggtctcgccgctgcaggtcttccagcgaggcggggctgctggccagggtgtacgggtgctgccccagctgggcctggacgtgattcccgcgaaacccgaactcgtgaaagatggtgttgatgggtcgactcagaaacgcccccgagagcttaacgtacatgttctgcgccgcgattcgcgtggcgcccgtgaccacgcagtccaggacctcgttgagggtctgcacgcacgtactctttccggatccggcgttgccggtgatgagatacgccgcgaacggaaactcccggagcggcaggccggtcgggacctccaaggccgccacgtcccggaaccactgcaggcgcggcacctgcgtgacgtcgagctgctgctgcgagagctctcggatgcgtgcgatgattggttggaccccgtgcatggacgtaaaatttaaaaacgcctcgtccctgaaccgcacggcgggtctggccccgggctgctgtgggggcggacctggtgcccggacgtcccgcgagccctccccgccggacgccgccatggccgcacagcgcgcgcgggcgccggcgatgcggacgcggggcggcgacgcggcgctatgcgcccccgaggacggctgggtgaaggttcaccccacccccgggacgatgttgttccgcgagattctcctcgggcagatggggtacaccgagggtcagggggtgtacaacgtcgtccggtccagcgaggccgccacccgacagctgcaggcggcgatcttccacgcgctcctcaacgccacgacgtaccgggacctggaggaggactggcgccgccacgtggtggcccgcggcctccagccgcagcggctggttcgcaggtaccggaacgcccgggagggcgatatcgccggggtggccgagcgggtgttcgacacgtggcgatgcacgctcaggacgacgctgctggactttgcccacggggtggtagactgctttgcgccgggcggcccaagcggaccgaccagcttccccaaatatatcgactggctgacgtgtctggggctggttcccatattgcgcaagacgcgcgagggggaggcgacgcagcgcctgggggcgtttctcaggcagcacacgctgccccggcagctggccacggtcgccggggccgcggagcgcgccggcccggggcttctggatctggccgtcgcgttcgactccacgcgcatggcggaatacgaccgcgtgcacatctactacaaccatcgccggggggagtggctggtgcgcgacccggtcagcgggcagcgcggcgagtgcctggtgctgtgcccccccctgtggaccggcgaccgcctggtcttcgattcgcccgttcagcggctgtgccccgagatcgtcgcgtgccacgccctccgggaacacgcgcacatctgccgtctgcgcaacaccgcgtccgtcaaggtgctgttggggcgcaagagcgacagcgagcgcggggtggctggcgccgcgcgggtcgtcaataaggcgctgggggaggatgacgagacgaaggccggctcggccgcctcgcgtctcgtgcggctcatcatcaacatgaagggcatgcgccacgtgggcgacatcaacgacacggtacgcgcctacttggacgaggcgggggggcacctgatcgacacccccgccgtcgaccacaccctccctgggttcggcaagggcggcaccggccgcgggtcggcgccccaggacccgggggcgcgaccgcagcagcttcgccaggcgtttcagacggccgtggtcaacaacatcaacggcatgctggagggctatatcaataatctctttggaaccatagaacgcctgcgagagacgaacgcgggtctggcgacccagctgcaggcgcgcgaccgcgagctgcggcgcgcccaggcgggggcgctggagcgggagcagcgcgcggcggaccgggcggccgggggaggcgcgggccgcccggcggaggcggatcttctccgggccgactacgacattatcgacgtcagcaagtccatggacgacgacacgtacgtggccaacagtttccagcaccagtacatccccgcgtacggccaggacctcgagcgcctgtcgcgcctctgggagcacgagctggtgcgctgcttcaagattctgcgccaccgcaacaaccagggccaggaaacgtcgatctcgtactctagcggggcgatcgcctccttcgtggccccgtatttcgagtacgtgcttcgcgccccccgagcgggcgcgctcatcaccggctccgatgtcatcctaggggaggaggagttatgggaggcggtctttaagaaaacccgcctgcagacgtacctgacagacgtcgcggccctgttcgtggcggacgtacagcacgcggctctgccccggcccccctccccaacccccgccgatttccgggcgagcgcgtccccgcggggcgggtcccggtcccggacccggacccgatcccggtcgcccgggagaacgccgaggggtgcgccggaccagggctggggcgtcgaacgcagggatggccgaccccacgcccgccgatgagggaacggccgccgccatcctcaaacaggccatcgccggggaccgcagtctggtcgaggtggcggaggggatcagcaaccaggcgctgctgcgcatggcctgcgaggtgcgccaggtcagcgatcgccagccgcggtttaccgcgaccagcgtcctgcgcgttgacgtcacccccagggggcggttgcggttcgttctggacgggagttccgacgacgcgtacgtggcgtcggaggattactttaagcgctgcggggaccagccgacgtatcgcggttttgcggtcgtcgtcctcacggccaacgaggaccacgtgcacagcctggccgtgccccccctcgttctgctgcaccggctctccttgtttcgccccacggacctccgggacttcgagctcgtctgcctgctgatgtacctggagaactgtccccggagccacgccacgccctcgctgttcgtcaaggtgtcggcgtggttgggggtcgtggcccgccacgcgtctcccttcgagcgcgtccgctgccttctcctccgcagctgccactggatcctgaacacgctaatgtgcatggcgggcgtgaagcccttcgacgacgagctagtcctgccccactggtacatggcccactacctgctggccaacaatccgccccccgtcctctcggccctgttttgcgccaccccgcagagctctgcgttgcagttgcccgggcccgtcccccgcacggactgtgtggcctataacccggccggcgtcatgggaagctgctggaattccaaggacctgcgttcggctctggtgtattggtggctttcggggagccccaaacgacggacctcgtcgcttttctatcggttttgctaactccggaaaataaacgtgttttttatggaacgttccccacctgtcgtgtcatctctcgggggatggtggtgggcctgtgtgtgtgtcttgtgcaccgaaggaggaaagtgggggggtggtggtgctggtggtggaaagacatgatagagggaacaaagaaatagaagaaaaccacaaccggcgcgtgccagtaaatacggacgcgcgcacacgcggggggtaagttggagcacggggccccggtttattgaccaaattcagggaaacagaaaccgcatcttttcctcgaaagggtacacaaagctcccgccctcgccccacacgccttccagaacccccgtaaacaccagttgaatctcgcgcaggatctcgcgcaggtgatgggcgcagtccacgggggggagcaccaagggccgcgggtacagatccacggggacgccgaccgactccccgcccccgggacatacgcgcacgacgcgtctccagtattgctccgcgtccagcagggcgcctccgcggaaggccgtttggggcagggggtcgtcggcctcgcctgggggggtcagaacgctccagtactccgcgtccagacgcctcccgaaggcatccaggacaaagcggtcacaggcgtcctccatgacgccccgggccgcgcacacggcctcctccggcgggccggcggccggccgccggaggattcgtctcagcgcgtcgcgcataacctcggccgccgcggcgtacgcgggcccgcggagaggaaatccctgcaggaagtcggtgtcatcgcgggagttccagaaccacgccccggtctggctccaggtgacgacgtgggtgtagacgccctctggcgccagggagggggcgaggcgcgggcgtatgccgttggccgaaagtacggcgcgcacggacgcctcgagggcccggcgggcgtcctggatcgcgccgtgcgcggcgtccgcgtccccggggtccacgttgaacagcccccagaacgcagccccggtgccgccgcagaccgcaaacttcaccgagctggccgtctgctcgatctgcaggcagacggcggccatgaccccgccgagcagctgccggagcgcggggcaggcgtcgcacgcgtccggcaccaggcgctccagcacggcccgggcccagggctccgagggggcggccgccaccagcgcgtccagcctttccaggcccgcccgcccccgggcttccggcagcccggcctccccgaggcccgcgagggcggccaggagctgggcctggagcccggagaaacaaaaccgcgccgtccagaccggcccgacggccgccggggggtcgagtagttggatggtggtggccgtggggtgccaccgcgccaccgcttcccgaaaggcgggcaggaggcggccggccgcctccgaggccacggccggccatgcccgcgggggcaggacgaccctggcgcccaccgcgggccaggcccccaggcacgcggcatgggtggccgcggcgccccgcaccaggtcacgcgccgactcggcggcggcggcggccggcacggtaaacgtgggccagcccggaaatcccagcacggcaaagtattggacgggccctccccggacctcaaacccgggccccagaaaagcgaagacgggggccagggctccgggggcggcgtggaccgtggtatgccactgccggaagagggcgaccagcgccggggcggagaacccgtcgccggcgctcacgaagtagtcgtagccgcgcggcagcagcacccgcgccgtgacccgctgcgggtgtccgcggggccgcaggccgacctcgcacacctcgaccaggtccgcgaaggcgccctccttcctggtcggcggaaacgccagggtggtgtattcgcgcgcaaaacgcgcggtcctcgtcgtgatggtgacggcgagcgaggcggaggacgcgcactgggggctgtcgcgaatggcggccaggcgcgcccacgccaaccgcgcgccggggtgctcggcgacgcgcgcggacagggccagcgggtcgacgtcgaccttggcctccacgtccaggagggcggcgcgaggagcggccggcgggccccacgacgccctttcgaccctcacgaccagacccgtctgcgggtcccagcccaggcgcagcgggacgaagagggccaccggccccgtctggcgctccagggccgccagaacgcacgcatacagcgcccgccacagggtcgggtcccccaggggctccagcggggaggcggccggggccgtcgcggcgcgggcggccgcgacggccccggcggccgagacgtcgggggagccgtagaagtcctgcaggtcggacgaaccaacggacacctccgcgaagcgcgcgcgcgcctcccccgcggcgtcgcgacagaccagatacagcagggcgtggaggcagtcgcgcgtgcgcgggggcagccataccgcgtatagggtaatggcgctgacgctctcctccacccaaacgatgccgggggcttccatgccacgacgcccgggggttgccgtgtatcgaacgagcgcggccccagacttatagggtgctaaagttcaccgccccctgcatcatgggccaggcctcggtgggaagctccgacagagccgcctcgagaatgatgtcagtgttgggctgggcgccggaggcgtgcgtgcgcaagcagcgcccccacgcgggcgcgcgcagcttgaagcgcgcgcccgcaaactcccgcttatgggccatcagcagcgcgtacagctgtctgtgcgtccggcaggcgctgtggtcgatgcggtgggcgtccagcagctccacgatggctcgcttggtgaggtttttaacgcgccccgccccgggaaacgtctgcgtgctcttggccagctgcaccccgaacagttcgccccagatgatcttgaacagcgacagcgcgtgctccgtctcgctcacggacccgcgcggggggcagccgctcagggcgtcggccacgcgcttaaccgcgtcctccgacagcaaggggccgtcggtcacgttacagtggcccagttcgaacaccagctgcatgtagcggtcgtagtgggggttcagcagctccagcacgtcctcggggctaaaggttcgccccgaccccccggccatcgagtcccactgcaggcacgcggccatggtgctgcacagacggaacagctcccagacgggggcgacgtttagggtggggtgtagggccacaagctccagctctccggcggcgttgatcgtggggatgacgcccgtggcgtagtggtcgtaaagccgccggaagatggcgctgctatgggcggccatggggacgcgaagacaggcctccagcagcaccaggtagatgaaccgcgtgcggccgaccaggctgttgaggccgcgcatgagcgcgaccacctcggccggcgcgacgtccggccggaggtacttttcgacgaaaaggcccacctcctccgtctcggcggcctgggccgacagggacgtgtcggggtcctggcagcgcagctcccgcagatcccgctgggccctcagggcatcaaaatgtatcccccgcaaaaacagacaaaagttcctcggggtcagcgcggcgtcgtggccccagaaccgcacgtgcatgcagttgagggtcagaagcatgtggaggatgttaagactgtccgcgaggcacgccagcgtgcacctctcgaagtagtgcttgtaccggaatttgctgtagatgcgcgacccccgcgcctgcgccgcgtcggcgtgcgacgcgtcgcagcgccctttgaaccggcggcacaacaggttcgtcacctgggaaaactgtgccggccactgcccgctggcgctcaccacgtggttgagcagcatgggcgtaaagacgggctccgagcgcgccccggacccgtccatgtagatcagcagctcccccttgcggagagtccgtacccgccccagcgactggtacacggacaccatgtccggcccgtagttcatgggtttcacgtaggcgaacatgctgtcaaagtgcggcggatcgaagctaaggcccaccgtcacgaccgttgtgtagatgaccacccggtaccggccccatgtggtcacgtcgccgggcggggtgagcgagtggagcagcagcacgcggtccgtaaactgccggcagaacctggcaacgacctccgcgaaggagaccgtcgacgagaagatgcagacgttatctccgccggccaggcgcgcctccagctccccgaagaaggtggcgtccgggggggcgtccggggggggcgccccgcccgccggccccggcgggcgcagggccgcctgcaggacctcgggccccaggcgcgggagaaacagacaacggcgcgccgaaaatccgggcatggcgtactccccgatgaccacgtgaacgttcttttcgccccggaggctgcacagaaagtccaccagctgcgcgttggcggtggcgtccatggcgatgatccgcgggcacgtgcgcagcaggcgcagcatcaacgcgtcgacgcggcccagctgctgcatcgtcggcgagtacagttggcccaacgtcgacatgacttcgtccaggacgagcacgtcgtagttgttcaacaggttcgggcccacgcgatgaagactttccacctgcacgatgagacggtggaaggggcggtcgttcatgatgtaattggtggatgagaagtaggtgacgaagtcgggcaaccctgactcagcgaaccgcgtcgccagggtctgagtaaaactccgacgacaggagacgaccagcacactcgtgtccggagagtggatcgcttcccccaaccagcggatcagcgcggtagtttttcccgagcccattggcgcgcggaccacagttacgcaccgggccgtcggggcgctcgcgtccgggaaggtgacgggtccgtgttgctgccgctcgatcgttgttttcgggtggacccggggaacccactcggccaaatcccccccgtaaagcatccgcgccagcgatacactcgacgtgtactgctcgcactcgtcatccccgatgggacgccgggcccccaggggatcccccgaggccgcgccgggcgccgacgtcgcgcccggggcgcgggcggcgtggtgggtctggtgtgtgcaggtggcgacgttcatcgtctcggccatctgcgtcgtggggctcctggtgctggcctctgtgttccgggacaggtttccctgcctttacgcccccgcgacctcttatgcgaaggcgaacgccacggtcgaggtgcgcgggggtgtagccgtccccctccggttggacacgcagagcctgctggccacgtacgcaattacgtctacgctgttgctggcggcggccgtgtacgccgcggtgggcgcggtgacctcgcgctacgagcgcgcgctggatgcggcccgtcgcctggcggcggcccgtatggcgatgccacacgccacgctaatcgccggaaacgtctgcgcgtggctgttgcagatcacagtcctgctgctggcccaccgcatcagccagctggcccaccttatctacgtcctgcactttgcgtgcctcgtgtatctcgcggcccatttttgcaccaggggggtcctgagcgggacgtacctgcgtcaggttcacggcctgattgacccggcgccgacgcaccatcgtatcgtcggtccggtgcgggcagtaatgacaaacgccttattactgggcaccctcctgtgcacggccgccgccgcggtctcgttgaacacgatcgccgccctgaacttcaacttttccgccccgagcatgctcatctgcctgacgacgctgttcgccctgcttgtcgtgtcgctgttgttggtggtcgagggggtgctgtgtcactacgtgcgcgtgttggtgggcccccacctcggggccatcgccgccaccggcatcgtcggcctggcctgcgagcactaccacaccggtggctactacgtggtggagcagcagtggccgggggcccagacgggagtccgcgtcgccctggcgctcgtcgccgcctttgccctcgccatggccgtgcttcggtgcacgcgcgcctacctgtatcaccggcgacaccacactaaatttttcgtgcgcatgcgcgacacccggcaccgcgcccattcggcgcttcgacgcgtacgcagctccatgcgcggttctaggcgtggcgggccgcccggagacccgggctacgcggaaaccccctacgcgagcgtgtcccaccacgccgagatcgaccggtatggggattccgacggggacccgatctacgacgaagtggcccccgaccacgaggccgagctctacgcccgagtgcaacgccccgggcctgtgcccgacgccgagcccatttacgacaccgtggaggggtatgcgccaaggtccgcgggggagccggtgtacagcaccgttcggcgatggtagccgtttcgttcgttttaataaaccgacgttgtgcgtttcaccatacttcggcgcgcgtgtgtgtgtgtttttttttttgtggtgtttattttccccccaccccttccttttctttcggccaccacccccctcctcccccgtactatacaacaaaaaataccacacatacgaccaaatacggacaatcatttctgtctttattcgctatcagagagtgggggcgtgagcgtggcaggagggcgggccacgtcggggtcccgccgtctggtgtgacgcgatggggggtccgatgcgcgccggtactggggccccggcgcccgggtgaccacgcgcacgtcggggggcacgtagaagttaccctcttcttcggactcgatgtccacgacgtcaaattcgtgggcggtcagcgagacgacctccccgccgtcggtggtgatgacgttgtgtcggcagcagcagggccgcgccccggagaacgcgaggcccataacttggcgagcgtatcgtcgaaggccaggcggctgtttcgccggatgtcccggtagatccccggctcgacgcggacgggggtgatgatcagggcgatcggaacggcctggtccgggaggatcgatgccttggcgggtccgggggccccgccacgcccggcgggcgctccgcggccgtcctccaggcggaacgtcacgccctcctccgcgcccgcgcggtgcctgccgaggaacgtcaccaggtgcggttgcagggggcagtcgggaaagtggctgtcgaggacgtatccctgcaccaagatctgtttgaagttcgggtggcgggggttggcgaagatgggctcgcggcgaaccagctccccggagctccaggccacgggagagatggtgcgacgctcaaggtcggggacgccaaacagaagcacctccgagacaacgccgctatttaactccaccagcgcccgatccggggcggagcatcgccttttttcgccggcggcgcgggaatcgagccagtcccggtcttgggtgacgagcgcctcctccgggcccggaacgcgcccgggcgcgaagtagcgcacgccggggttggggatggaccggatgaacgcccggaacgcctccggcgatcgccgcgccatcaggtcctcgtacgcggaggccgcgggggcgccggggtccgcggggtcgaacgcgtacttggctcggcacttaacctcgtagaaggccaggggggtctggggggcgggggccaggtagccgtgagggtccctggggcacacgaggatgtccagggacgcccccaccatgcccgtgtggccgtccatgaggaccccgcacgcgtgcacgttctcctcggcgaggtccccgggttggtgaaagacgaagcgcccggcgtcggcgtcgtcgttgacgcccgcgtccgcgcggcccacgcagtagcgaaacagcaggtttcgggccgtcggctcgttcacccgcccgaacatcaccgccgacgactgggcgtccagccgcaggctggcgttgtgggtgagccactgggacgagaagcacggaccctgcgcgccccaccgcagcgtggaggcggtcgtcaggccccgccgaagcagggcccagagctggcagtcggcctggttttgcgtcgccgcctcgtaaaatcccataagcgggcggggggcgacggcttcggcggcggacgggggggcgcggcgcgtcaggcgccagaggtgccggccgagcccgcggtccaccatgccggccgcctccagcgacacgacgagggagcacagatagtccaggcgagcccacaggggcccgatggccagaggggagcggacgccgcgcagcaggccgcgcaggtggcgctcgaacgtttccgccaagatatgggggggcagtgcgttggggatcgccgacgccgaccacatcgggtcggggtccgggggaccggggctgcagtccgggtcgatggcgtgtgcgccccccggcgagaggggaatgtcgggggttggcgggccggatgaggcctcagagagggccggggacgcgggccgggccttttcgcccggggccccgccgtcgggttgcccacgtggggggctctggggccaatgggaacccggggcccccggtgacgtggggcggggtggggcggggcggggcccaaagacggtcgccagatctaggctgttgggtcggggccgcttcgggggactatcggggtcgcgggcggggtccgcggggcgcttggcgccgggtgttgcggcggccgccatttttacgagcagccgaagagctcgagggcggaagggatcctcacgacagagagtggcgcgcggccgggttggcgtgacagaggcgggagaccagcaccagcagcggcctcagctcgggcggcagcgacaccgacgacaggacggccttgtgcgtgcgctggtaatttatacactgctccgtgaacgcgcgccgaatcttgggattgcgaaggtggcgccggatgccctccggcacgtcatacgccaggccgtgggtgttggtctcggccgagttgacaaagagggcggggtgcagaacgcagcgataggcgaggagggccacggcaaagtccggcgagagctggttgttaaagtactggtagcccgggacgcgggtcacggggacgcccaggctcggggccacgtacacgctaaccagcagctccagcagcgtctgccccagggcgtagagatcgaccgccagcccgacgtcgtgcttcagggggcggttgttaaactcggcccgctcgttgttgaggtactttaccgagagctccggtggctggttgtacccgtgccccaccagagtgtgaaagttggccgtggtcagggcggcgggcatcccaaacccccggggggactcgaggtccggctcctggaggcaaaactggccccgggatatcgtggagttggagttcagggtcaccaggctaaagtcggccaggacggcccgccggagcgacaccgcgtccgatcgcagcatcacgaggacgttggcgcacttgatgtccaggtggctgatcccgcacctggtgttcaggaacaccacggcgcgcgccaggtctgtgaagcagtggtggagggccgtcgcgacggagggggtggtcgcgcgcagggacgccagctggccgatgtacttgccgaggtccatgtcgtacgcggggaacacgatctggcgctgctgcagcgagaacccgagcggggtgataaagccgcggatgtcgtgggtgcggccgccgcgaagagcgcactcccccacgagcagggtcgcgacgagctccacggcaaaccactctttttcccggatggtcttcacggcgagcttgtgttcgcgaatcaactgcacctcgccgtacccccccgagcccccgaagctgcgggccccggggatctccagggtcgtgtagcggagggcggggttgacggcgaatacggggatgcatagcttgtggatgcgcgcgagggacaggatgtgcgaggggggcgacgggggcgaggtcatggccgtctcggacctgcgcaggggcgggcgccttagcttggccgcagggccgggggcctcgggggacgagcggcgacgagacgagcggctcactcgccatcgggacagtcccgcgcgaagccgctcccggaagctggatcggcggcgggacccggggcgggctccggagacggcgccgtctcggggggaggggccgcttgggcgtccggacgcccggcggctgagggagtgtatgtaggacgcgagccaggccttgaaggagcgtcggtgtgcaccttgggggctgatgtcagctgccacatgactagcaggtcgctgtcgcccggactcatccatccgtccgccaggtcgccgtccccccacagagacgcgttcgccgcggcctcttcgagctgctcctcctggtccgcaagacgatcgtccgccgcgtccaggcgctcgctaagcgcgggatcgaggtaccgtcggtgtgcggttagaaaatcacgtcgcgccgcttgctcttccacgcgaattttaacacaggtcgctcgctgtcgcatcatctctaagcgcgcgcgggactttagccgcgcctccaattccaagtgggccgccttggcggccataaaggcgccaacaaacctaggatcttgtgtactcacgccctcccggtgtagctgcagggtctggtccctgtacacctcggcccggaggtgcgtctcggccaaacgtcggcgcagggccgcgtggctggcgtctcggctcatctcgccgcccccgcgcgcgcccgacgtcggactccttcgccccgacccccctgacctcagccgcccccgcctcgcccgcgatgtttggccagcagctggcgtccgacgtgcagcagtacctggagcgcctggagaaacagaggcaacagaaggtgggcgtcgacgaggcgtcggcgggcctgacgctcggcggcgatgcgctgcgcgtcccttttttggattttgccaccgcgacgcccaagcgccaccagaccgtggtcccgggcgtcgggacgctccacgactgctgcgagcactcgccgctcttctcggccgtcgcgcggcggttgctgtttaatagcctggtgccggcgcaactcagggggcgtgactttgggggcgaccacacggccaagctggagttcctggcccccgagctggtgcgggcggtggcgcgcctgcggtttcgggagtgcgcgccggaggacgccgtgccccaacgcaacgcctactacagcgtcctgaacacgtttcaggccctgcaccgctccgaagcctttcggcagttggttcacttcgtgcgggacttcgcccagttgttgaaaacctcgttccgggcctctagtctcgcggagactacgggccccccgaagaaacgggccaaggtggacgtggccacccacgggcagacgtacggcaccttggagctcttccagaaaatgatactaatgcacgcgacctactttctggccgccgtgctgctcggggaccacgcggagcaggtcaacacgttcctgcggctcgtgttcgagatccccctgtttagcgacacggccgtgcggcacttccgccagcgcgccaccgtgtttctagtccccaggcgccacggaaagacctggtttttggtgcccctcatcgcgctgtcgctcgcgtccttccgggggatcaagataggctacacggcccacatccgcaaggcgaccgagcccgtgtttgatgagatcgacgcctgcctgcggggctggtttggctcgtcccgggtggaccacgtcaagggggaaaccatctcgttctcgttcccggacggctcgcgcagcacgatcgtgtttgcctccagccacaacacgaacgtaagtacgccttcctcccgcggtgcctgtttccccggtgccgccctccccgagatcgaccgacagacaaacacagccagacgcgagtgtgggacgacacgcccgcagccccccccccgccatggcgggggggaagccttactgtttatttgtaatcggacgatgaggctctggccacggcccgcgcgaccgcggggcagctcgttgcaaacaggcggctggtatacgatgacagaacgcagaggcgccacccggcgctggtcgggcggatgacgctttccgcgccgtcccggcccacgacgacctcgtgcaggtgggccgtgatgcgcgggcggcgggtcgcctgccgcaggataaccgcgtccacggggtgcccgaagaggagctgacacaggctcgcgtccccccggacggccagggtgcgctgggccatattggaccacatgcacggggcgacgcagggacaggcctccgccacggcgggggcgcgccacagcgcgttggcggaatcgatgtgggccgtcggggcgcaggcgccgcctcctcccggggggtcggtaatcctggatagcagccatcctaaatggcgggcccggctgcccgggggacagagcgaccccaggtcatcatccatggcccagcagtatatgcggccgccggggaggtgccaccaggcccccggacccagggcacagcacgcccccggattcgggggcggttccgtgggtaccaggtaggcgccgtcgagctcgtgggccacgggctcgtccgcgagctgttcggcggcggggtcgggggtttcctccgggggggaggcagcttccaggtggccgaaggctagggtgcacagcagcggggtccgggggtgcgttacgctgcggaggtggacggtggcgcagtagcggcgctcgcggttaaagaagaaaatggcaaagaacgtgttcgaaggcaggcgcagcgccttgggccgcgtcaggtacaggaagatctcgcagaaaagggcacgctcggggtcggggtccggaagggccacctggcacagcggctcggtgaggaccgtgaggcaccgaaaaatcttaagccgctcgtccccccgaacgacgcgccacacgaagacagagttggcgatgcgcgcgacgaggtcggcttcgggccccgggtcgggggcgcgcgcgtcggggggggcgccccggtgacccggcggggccgcggctcccggggggcctggcgtcgcctggggacgccagagtgcccgctgtgccaggttggtggtggggaagggaccggagacgcaccaaaagcagaggggccagcgcgtgtatgagttggggggggggtgggtgagcggtggaacaaaagcacgcgtcagcggacaaggccgggtcccgtagccgccccgcgacagaaccggagtccgacggcacgcgcgacggggtctgcgaggctgaggtacgccgcggtgttaatggtaaacgcaaagcctcccggaaagaccactagcccgcagaggcggcgattgaacccaaggcagaggtacgcgtagctctctcccggaaggtattgctcgcagaccctgtgtggggcagtggaggggctgccctccatgaagcgacatttactctgctcgcgtccattgacgtcaccgtcaatcaccactgcgattggacggttggtgaggcgcagcgtgtctccgctggtgctgtagtagtcaaacgcgtagtgggcgtcggagtcggcgaagcgggcggggatgtcgtcgctgagagggacgagccgccgccgccgcccccgaccgccctggccgcccagatgcgccagcacggccagggcgtacgcggtgtgaaagaacgcgtcgggggcggtcccctcgagggcgcgcatcaggttctccaggagcacggggaagcgccgcgtcacctcccctagccactcgctctggtgggggccaaagtcgtagcgcaggcgctggaagatgcgcgggccgccttggagcgcggcccggatagagtggcccagggcccgcagacacgcgatctggatgcgcgcgacgaaggccacctcggccgcgatgtcaaagggctgcagcacggggcgcgggtggcgcaggggtccctcgagcgcgggaaagcgacgcagcagcgccgtctgggccgcgggggacagctggtgggggcgcacgacgcgctcggcggcacaggcctccgtcagggccgtggccagctcggaggacagccgcggggggcgggcgcgtcgcccgccccacgccaccgaattctcgtaggagacgacgacgaagcgctgcttggtcccgtagtgatggcgcaggaccacggagatggagcgacggctccacagccagtcgggccggtcgccgccggccagagcttcccacccgcggtccagccactcgaccagcgatcgcggcttggcggtccccggcacgagggtgagcacgtcgttgaggacgtcctcgcccgcggcccgggggccccccggggtggcaaagcgccccccgccgggcggctccaggcccgccagcaccgcctccgcgtccgacgcgcccagggctcccccgctgacggcctggtggaccagggcgccctggcggagccccgaggcgacgccggaggccgcgtgcttggggcgcgcgcggaccgggtggcggcgggtgacgtcctgcacggcccgctggaccagcgcgaggatctcctcgttctcttgcgtgatggacacgtcctccgcggtggccgtgtcgcctcccggggccgtgagctgctcctccggggagatgggggggtctggggtgccgacaacggccggcccggccccgcccgagaccgaggacgcctggggagtgggggtgccgctttcccccatccccagggacaggtgggccgccgcctccgtcgcggcggcgggagccgcggcccccagccgcgcgacgtagcgacaaaagtggcgacagaggcgcatgaggcgcgcgccgtcggccgcgtatcgcgtgtttggcgggacgagctcgtcgtaactgaacaggagcacgcgggcgcaggtcgcccacgggccccacgccaggcgcagcgccgcgaccgtgtacgggtcgtacacgccttgggcgtcgcacgcgaccggcagggagacgaacagcccgcccgcgctggggacgcgcggcaggaggtccgggtgcgccgggatgacgggggctaggatcgcccccaccgcatccgccggcacgtaggcggcaaacgccgaacgccacggggtgcagtcgccggtcgcgtgggcccgggtctgggtttcgacccggaagttcgcggccgccccaccgtcggggcggccgcgcacgagggcggacagcgggacccccgccgccgccaggcactcgctggagatgatgacgtgaatcagcgaggcggggctgctcgggtcccgggtgagatcgtattggacctcgttggcaaagtgcgcgttcatggcccggccggcggtgcgagcccttcccggtgccggaaggggcgtgggtggggggtgcgtgtgcgcgtcctcggggcccgcgggcgcacgtgcgcttatacgctgtgtgtttcgtctgtccccagggaatccggggccaggactttaacctgcttttcgtcgacgaggccaactttattcgcccggatgcggtccagacgattatgggctttctcaatcaggccaactgcaagatcatcttcgtctcgtcgaccaacaccgggaaggccagcacgagctttttgtacaacctccgcggggccgccgacgagctgctcaacgtggtcacctatatatgcgacgaccacatgccgcgggtggtgacgcacaccaacgccacggcctgttcctgctatatcctgaacaaacccgtgtttatcacgatggacggcgccgttcgccggacggccgatctgtttctgcccgactccttcatgcaggagatcatcggggggcaggcccgcgagaccggcgacgaccggcccgtcctaacaaagtcggcgggggagcggtttctgctgtaccgcccctccaccaccaccaacagcggcctgatggcccccgagctgtacgtgtacgtggacccggcgttcacggccaacacgcgcgcctccggcaccggcatcgcggtcgtcgggaggtaccgcgacgatttcattatcttcgccctggagcactttttcctccgcgcgctcacgggatcggcccccgcggacatcgcccgctgcgtcgtgcacagcctcgcccaggtgctggcgctgcaccccggggcgtttcgcagcgttcgcgtggcggtcgagggcaacagcagccaggactcggccgtggccatcgccacacacgtgcataccgagatgcaccgcatcctggcctcggcgggggccaacggcccggggcccgagctcctcttctatcactgcgagccgcccggcggcgcggtattgtaccccttctttctgctcaacaaacagaagacgcccgccttcgaatactttatcaaaaagttcaactccgggggcgtcatggcgtcccaggagctcgtctccgtgacggtgcgcctgcagaccgacccggtcgagtatctgtccgagcagctcaacaacctcatcgaaaccgtctctcccaacaccgacgtccgcatgtactccggaaaacgcaacggtgccgcggacgacctcatggtcgcggtcatcatggccatttacctggcggccccgaccgggatccccccggccttttttccgatcacgcgcacgtcttgagtctttcttgccgtttcttttgtttctctttctttccccccctctctccgcaataaacgccttcccggaactgtgtttccccccctacaacagtgttgtccgttggttgggtggttggggtgcgggggtgggcgggggaagcaagaaaacggtcggcgaacacaacatcgggaaaacggattcccgcacgtgcgtcttcccagattcgacacacacaccccccttctccttaaataaacacaaaccacacgctcgttggttggttaatgccagcgctttatttacgtcttgttttttttgcgtttcctccgcgggtcccttcccaacacgcctgcccccgcctcaggggtagcggataaccggggccatgtcgccggattgcacaacggcggcgccgtcgaacgtacacacccgaaccgccggggccagggccaggatgtccccgagttggcccgcgtgcgccagccaggcgaccagcgcctcgtaaagcggcagcctgcgttcgccgtcctgcatcagcatgggggcttcggggtggatgagctgggcggcttctcgcgtgacgctctgcatctgcaggagcgcgttcacgtatccgtcctgggcgctcagcgcgagcagccgggggatgagcgtgaggatgagggtggttccttcggttatggagtagaccatgttgaggacgagcgaccgcagctcggtgtttacggaggcgagttgctggacgtcggccacgagcgagagacgggccccgttgtaatacagcacgttgaggtcggggagctccccgggcgtccgggggtcggggttgaggtcccggatgccccgggcgaccagccgcgcgactatctcgcgggccaggggcgttgggagcgggaccggaaaccgcagcgtgaggtccagcgactccaggcgcacgtccgtcgcctggccctcgaagacgggcgggacgaggctgacgggatccccgttgcagaggtcgacgggggaggtgttgcggagattgacggtgccggcgtgcgtgagccccaggtccacggggcaggcgacgattcgcgtgggcagcacccgcgtgattaccgcggggaagcgcctgcggtacgccagcaacaaccccaacgtgtcgggactaactcctccggagacgaacgattcgtgcgccacgtccgcgagcgccagctggcggcggatggtcggcagaaagaccactcgaccctcgcaccgctgcagcgccgcggcatcggggcgcgagatacccgaggggatcgcgatgtctgcttcgaaacaatccgtgatcatggcgccgggccgcgagacaccggaacgcgggggtgcgggagggccggaaagcgcaacgcaaccgggacgatgatgaaacagagatggggggcaccgaccgtgtgggagagggggcggggcagggctcagcagcacgcacggggaggtctgtcgtgcgcaggagccccaggtgagaatcagtcccccggagctcgggtctgggttttattgggacctgccctcggaatcgcggctcccagtccaagcccccctggggggggcggggacagggggtgtgtgtgggtaaaagcaacgtcggaaaatcaaacccaatgccccaaacaggaaaaaaaaagacgggcgggtggagggaaagctggggaagaagaagccaattttacagagacaggccctttagcggggaggcgtcgtagatgagatactgcgtaaagtgggtctctcgcgcgtgggcctccccatcgcgggcgctgcgtagcagggcggggtcgctggcgcaggtgatcgggtaggcttcctgaaacaggccgcacgggtcttccacgagctcgcggcaccccggcgggcgcttaaactgcacgtcgctggcagcggtggccgtggataccgccgatcccgtttccacgataagacgctccaggcagcgatgtttggccgtgatgtcggccgcggtgaagaacttgaagcaggggctgaggacgggcgaggccccgttgaggtgataggccccgttgtacagcaggtccccgtacgagaaccgctgcgacgcccacgggttggccgtggccgcgaagggccgcgccgggtcgctctggccgtggtcgtacatgagggctatgacgtccccctccttgtcccccgcgtacacgccgccggccgcgcgtccccgcgggttgcagggccggcgaaagtagttgatgtccgtggccacgggggtggcgatgaactcacacacggcatcctgcccgtggtccatgccggcgcgccgcggcacctgggcgcagccaaagaccgggaggggctgggccggccccagccggtttcccgccacgaccgcgttgcgcaggtacacggcggccgcgttgtctagcagcgggggggccccgcggccgaggtaaaagttttgggggaggttgcccatgtccgtaacggggttgcggacggtggccgtggccgcgacggcggtgtagcccacacccaggtccacgtttccgcgcggctgggtgagcgtgaagttgacccccccgcccgtttcgtggcgggccacctggagctggcccagaaagtacgcctccgacgcgcgctcggaaaacagcacgttctcggtcacgaagcggtcctgccgcacgacggtgaacccgaacccggggtggaggcccgtcttgagctggtgatacagggccacggggctcatcttgaagtaccccgccatgagcgcgtaggtcagcgcgttctcccccgccgcgctctcgcgggcgtgctgcaccacgggctggcggatggaggagaagtagttggcccccagggccggggggaccagggggacgtggcgcgccaggtcgcgcagggccggggggaagttgggcgcgttggccacgtggtcggcgcccgcaaacagcgcgtggacgggcaggacgtagaagtattcgccattttggatggtgtggtccaggtgctggggggccatgagcagcacgccggcgtgcagcgccccgtcgaagatgcgcatgttggccgtcgacgcggtgttggcgcccgcgtcgggcgccgcggagcacagcagcgccgtcgtgcgctcggccatgttgtgcgccagcacctgcagcgtgagcatggcgggcccgtcgacgacgacgcgcccgttgtggaacatggcgttgaccgtgttggccaccagattggcgggatgcagcgggtgggcggggtcggtcacgggatcgctcgggcactcctcaccgggggcgatctccgggaccaccatgttctgcagcgtggcgtacacgcggtcgaagcggacccccgcggtgcagcagcgcccccgcgagaaggccggcaccagcacgtaatagtagattttgtggtggacggtccagtcggccggccggtgcggccggtcgtcggcggcgtcggccgcgcgggcctgggtgttgtgcagcagccggccgtcgttgcggttaaagtcggccgtcgccacgttgcacgccgccgcgtagacgggctcgtgcccccccgcgtcaatccggcagtctcggtggcggtccagggccgcgtgtcgcataaggccgtcgcagtcccacacgaggggcggcagcagcgccgggtcgcgcatcaggtgattcagctcggcctgagcctgcccgcccagctccgggcccggcagggtaaagtcgtccaccagctgggccagggcctcgacgtgggccaccaggtcccgatacacggccatgcactcctcggggaggtcgcccccgaggtaggtcacgatgtacgagaccagcgagtagtcgttcacgaacgccgcgcatcgcgtgttgttccagtagctggtgatgcactgagtcacgagccgcgccagggcgcagaacacgtgctcgctgccgtgaatcgcggcttgcagcaggtaaaacaccgccgggtagctgcggtcctcgaacgccccgcggacggcggctatggtagccggcgccatggcgtggcggccaacgccgagctccaggccccgggcgtcacgaaacgccaccggacacagcgccaggggcaggttgccgttgaccacgcgccaggtggcctggatcgcccccggaccggccggggggacttcgccgccgggaagctcgacgtcggccacgcccgcgaagaagtcgaacgcggggtgcagctccagagccaggttggcgttgtcgggctgcatgaactgctccgcggtcatctggcactcggcgacccaccggacccggccgtgggcgaggcgctgccgccaggcgttcagaaaacgctgctgcatgtccgcgccggggccggccggggccgcgacgtacgccccgtacggattcgcggcctcgacggggtcgtggttcacgcccccgacggccgcgtcgatgttcatgagcgaaggatgacacacggtcccgaccgcgttctccatggacagccgcagaacctggtggtcctttccccaaaaaaacagctgccggggagggaacgcgcggggctccgggtggccgggggcgggcaccaggtccccggcgtgcgcggcgaagcgctccatggccgggttgaacagccccaggggcaggacgaacgtcaggtccatggcgcccaccagggggtagggcacgttggtggcggcgtagatgcgcttctccagggcctccaggaagaccagcctgtcgcctatggccaccagatccgcgcgcacgcgcgttgtctggggggcgctttcgagttcatccagcgtctcccggttcgcctcgagttgctcctcctgcatatccagcaggtggcggcccacgtcgtccaggctccgcacggccttgcccatcaccagcgccgtgacgaggttggccccgttcaagaccatctcgccgtaggtcaccggcacgtcggcctcggtgtcctccaccttcaggaaggactgcaggaggcgctgtttgatggcggcggtggtgaccagcaccccgtcgaccggccgcccgcgcgtgtcggcgtgcgtcaggcggggcacggccacggacggctgcgtcgccgtggtcaggtccacgagccaggcctcgatggcctcgcggcgatggcccgccttgcccaggaagaagctcgtgtcgcaaaagctccgcttcagctcggcgaccagggtcgcccgggcaaccctggtcgccaggcgcccgttgtcgagatatcgttgcatgggcaacagcagggccaggggaggcgccttctccaacagcacgtgcagcatctggtcggccgtgccgcgctcaaacgcccccaggacggcctggacgttgcgcgcgagctgctggatggcgcgcagctggcgatgcaggctaatgcccgtcccgtccagggcctcccccgtgagcagggcaatggcctcggtggccaggctgaaggcggcgttcagggcccggcggtcgatgaccttcgtcatgtaattatgcacgggctgctcgacggggtgcgggccgtcgcgggcgatgaggggctggtggacctcgaactgcacacgcccttcgttcatgtaagccagctccgggaacttggtgcacacgcacgccacggacaggccgagctccagaaagcgcacgagcgacagggtgttgcagtaggaccccagcagggcgtcaaactctacgtcatacaggctgttttcgtcggagcgcacgcgggcgaaaaaatcaaagagtctgcggtgggacgccacctcgatcgtactcaggatggagccggtgggcaccatggccgcggcgtaccggtaacccggggggtcgcgggcaggagcggccattgggttccttgggggattcgcaggctccatcaagccgagctcgggaaggccaagcccctcccgcacaacgcctcaccgccggcggacgcgactaacaacccacgggccgccaaaaccccaaggggcaacccgaccaacaacaggcgaggggaggaaaggcgtaaagggggcgttgggaggcaaaaagaaagaaaacacccagacgtaggcccgaggaccggccggcgtcctctgtccccgagcacccactgtgcccaacaggcacgggggcgagctgcccctgccttatatacccccccgccacacccccgttagaacgcgacgggtgccttcaagatggccctggtccaaaagcgtgctagaaaaaagttggtaaaggcggcaaagcagtccgccgccgccacccacatggcggcgccggccgcgcaggcgattcccagagaacgggcgcggaggggatccgtgcggggcagcagctggctggcggtgatccaatggaaaagcccgtcgggactgaacgtctcatgggcggccgccaccagggcgcacagggccgcgccgcccatgatcacgcacaacccccaaaacacgggtggcgacaacggcaggcgatcccgtttgatgttcacgtacaggaggagcgcccgtgccagccacgtgacatagtaggcgaggacggcggctataatacatgccggcgccaccgcccgtccggtccacccgtaatacatgcccgcggccaccagctccagcggcttgaggaccaggaacgaccaagcaaacatcaccacccgcttggaaaagaccggctgggtgtggggcggaagacgcgagtaggccgaactgacaaaaaaatcagacgtgccgtacgaggacagcgaaaactgttcatcgagcggcagttctccgtcctccccgccacacgcggcctcgtctaccagctcgcgatccaacaaaggaacatcatcccgcattgtcatggtcggtgcggggagccggcgaggcagcaaaaccgaaagtagtgctggcggcgcgggcccgggtccggacccaagcttcagggatggggggcggaggccaaaatcaaacaagcaccgcgcgggttctacacacaacccccacccgggtagtatccgcggatgcgagtgcctggcgaagtcacgtcccagcaggatataaacctcggccgttgggcccggaacccccgaaattcacacccacgccctgacgcccaaatcatgggtggatgtggttcgcgagccgcacatccgtgcgtccgccctcccccgcgggctgatgacgtggcggttagtcagtgggaaggcagggggaaagatgggttgggggaggaaacgaagaaaacacccagagggccacgtcgggaatgcgcccggagttgtccttaaaaggccggccgtgcgtgacggaagccgtcgtttgcccaagcaccgacgccgcgatccacagtggggggagttcctccgtccggccacaaccctacgcgcgggcggcacgcgcgagagcaacccacgggtcccgttcgcgccaccgccagcccttgctcccaccaccctcctcccaccaccccactattcccccccccaagtccgccccgtggctcgccggccatggagctcagctatgccaccaccctgcaccaccgggacgttgtgttttacgtcacggcagacagaaaccgcgcctactttgtgtgcggggggtccgtttattccgtagggcggcctcgggattctcagccgggggaaattgccaagtttggcctggtggtccgggggacaggccccaaagaccgcatggtcgccaactacgtacgaagcgagctccgccagcgcggcctgcgggacgtgcggcccgtgggggaggacgaggtgttcctggacagcgtgtgtctgctaaacccgaacgtgagctccgagcgagacgtgattaataccaacgacgttgaagtgctggacgaatgcctggccgaatactgcacctcgctgcgaaccagcccgggggtgctggtgaccggggtgcgcgtgcgcgcgcgagacagggtcatcgagctatttgagcacccggcgatcgtcaacatttcctcgcgcttcgcgtacaccccctccccctacgtattcgccctggcccaggcgcacctcccccggctcccgagctcgctggagcccctggtgagcggcctgtttgacggcattcccgccccgcgccagcccctggacgcccgcgaccggcgcacggatgtcgtgatcacgggcacccgcgcccccagaccgatggccgggaccggggccgggggcgcgggggccaagcgggccaccgtcagcgagttcgtgcaagtgaagcacatcgaccgtgttgtgtccccgagcgtctcttccgcccccccgccgagcgcccccgacgcgagtctgccgcccccggggctccaggaggccgccccgccgggccccccgctcagggagctgtggtgggtgttctacgccggcgaccgggcgctggaggagccccacgccgagtcgggattgacgcgcgaggaggtccgcgccgtgcatgggttccgggagcaggcgtggaagctgtttgggtcggtgggggctccgcgggcgtttctcggggccgcgctggccctgagcccgacccaaaagctcgccgtctactactatctcatccaccgggagcggcgcatgtcccccttccccgcgctcgtgcggctcgtcggtcggtacatccagcgccacggcctgtacgttcccgcgcccgacgaaccgacgttggccgatgccatgaacgggctgttccgcgacgcgctggcggccgggaccgtggccgagcagctcctcatgttcgacctcctcccgcccaaggacgtgccggtggggagcgacgcgcgggccgacagcgccgccctgctgcgctttgtggactcgcaacgcctgaccccgggggggtccgtctcgcccgagcacgtcatgtacctcggcgcgttcctgggcgtgttgtacgccggccacggacgcctggccgcggccacgcataccgcgcgcctgacgggcgtgacgtccctggtcctgaccgtgggggacgtcgaccggatgtccgcgtttgaccgcgggccggcgggggcggctggccgcacgcgaaccgccgggtacctggacgcgctgcttaccgtttgcctggctcgcgcccagcacggccagtctgtgtgagatatcccaataaagtgcagtcgttttctaacccacggatgccgttgtatgcctatacgggggactatggggggggaaaggaaaggaaacaggaatggagaagggaaaggaacagaggcggtagcggacgcacggcggacacaataacaaacagaccgcggacacggagggagtcggttgggttgggcgtggacgccgctgcgtccacacacccgtttattcgcgtctccacaaaaatgggacgcacgttcggaccaccctaaggatgcccgccagggccgcggtaatcataacgacccccagcgcggacgcggccagaaacccgggggcgatggtggcgatgggcagcgtgtcaaaggccagcagatgaatcacagttccgttggggaacaacaacagggccacggacggcacgtcgctggaaaacacgttcggggtgcccgccaccggcccctgggccagctgctgttgggtggcatccgtgtccaccagcagcaccgacatgacctccccggccggggtgtagcgcagaaacacggcccccacgaggccgaggtcgcgccggttttcggtgcgcaccagccgcttcggctcaatctcccgcgcgtgcccttcgcaggtggcggtgagataggtgataaacagcgggcggcggacgtcaacgcccgtaagcttgtatccgatcccgcggggcaagggggtgtgggtgacgacgtagctggcgttgtgggtgatgggcacgaggatccggggctccgcgttgtgcgacgggccgctacactggtgggtggcctccgggacgaaggcgcggatcagggcgttgtagtgcgcccagcgcgtgagaacggaggccacgccgcgggtctgttgtgccatgacgtccgccgggatgtcggatcgggtggccatggccagcgcgtccaggatgaacccgccctcggcgagatcgaagcgcagggaagctgcgcatggggaaaagtggtccgggagccagaagaggtttttctggtggtcggtcctggctagcgcggcccggagatcggcgtgggtcgccgcggcgacgtcggacgtacacagggccgtggttatgaggaggccccggcgggcgcgttcccgctgctcggccgagggcgcgcccgccaggaacggcgcccggaggacggccgtggcgtaaaacagcgctcggcggaccatcggggcggttagcgcgcggccgccgagaaactcggcgtacagggcgtcgatcaggcgggccgcgctcggggccaccgcgccataggccgcggggctgtccaacacgaacgccagctgatagcccagcgcgtgcgccgccaggctctgctctcgctcgaggatcgcggccaccagatgcccgaggcgcgcctccagccgcaggcgggccgccgggtccaacacggacacgttcaggaacaccgagtcggccgcgcagcccgctgctccccgggcggccaggccggccagcacgcgcgagtgggccaaaaagcccagcaggtcggagaggcgaatcgcgtcgtgggcgtgggccgcgttgacgaacgcaaaccccgacgaggcgagcagccccgcgaggcgccagaacagggacggacgcgcgtccgtgccggagcccgggtcctcccccaaaaactccgcataggcccgcgacatatactgggcgtagttcgtgctctcctcggggtagccggccacccgccggagggcgtccagcgccgagccgttgtcggcgggcgtcggggcccccaggacaaagacgcgatacctggggccggccggaggcccggggagcaccgcgggggcgttttcgtcggtcggatttccgacccgagcgagggtcttgtccgcaggcaccactatgatctcggccggagggctgtcccgcatcgatatcacgagccccatgaagcccttcccgtatcgcgcgcgcacgagcgcggcgtcgcacccgaacgccagcccgcccgtcgtccagacgcccacgggccacgtcgaggccgacggggagaggtacacgtaccgacccggagtccgtagcaggcccctggcggccagccaggtcacggatgcgttgtgcagatgcgcgatgctcaggttcgtcgtcggatgcctcggtgtccccgcgggcggccccgggggcggcgcgttgcgtcggccgtccgggtgcctctcggtcgccccgtcgtctccccgcgggaacgtaagcccctcgcggtccggcgcggccgcgaatgttacccaggcccgggaccgcaacagcgcggaggcgccggggttgtgcgacagtcccttgagctgggtcacctcggcggggggacgggacgtgggccccgcctcggggagctcgggcaggctcgcgttccgaggccggccgagcagataggtctttgggatgtaaagcagctgcccggggtcccgaggaaactcggccgtggtgaccaacacgaaacaaaagcgctcggcgtaccaccgaagcatgggcacggatgccgtagtcaggttgagttcgcccgggggcgccaagcgtccgcgctgggggtcgctggcgtcgggggtgttgggcaaccacagacgcccggtgtttgtgtcgcgccagtacgtgcgggccaaccccagaccgtgcaaaaaccacgggtcgatttgctccgtccagtacgtgtcatggcccccggcaacgcccaccaggacccccatcaccacccacagaccggggcccatggtcgtccgtcccggctgccagtccgcagatgggggggggtgtccgtacccacggcccaaagaggctccgcacctcggaggctatcggaggccctttgttgccgtaagcgcgggccaaaggatggggtggggtgagggtaaaagcacaaagggagtaccagaccgaaaacaaggacggatcggcccgctccgtttttcggtggggtgctgatacggtgccagccctggccccgaacccccgcgcttatggacacaccacacgacaacaatgccttttattctgttcttttattgccgtcatcgccgggaggccttccgttcgggcttccgtgtttgaactaaactccccccacctcgcgggcaaacgtgcgcgccaggtcgcgtatctcggcgatggacccggcggttgtgacgcgggttgggatcatcccggcggtgaggcgcaacagggcgtctcgacacccgacgggcgactgatcgtaatccaggacaaatagatgcatcggaaggaggcggtcggccaagacgtccaagacccaggcaaaaatgtggtacaagtccccgttgggggccagcagctcgggaacgcggaacagggcaaacagcgtgtcctcgatgcggggcagagaccccgcgccgtcctcggggtcggggcgcggggtcgccgcggcgacccccgtcagccggccccagtcctcccgccacctcccgccgcgctgcaggtaccgcaccgtgttggcgagtagatcgtagacacggcgaatggcggacagcatggccaggtcaagccgctcgcccgggcgttggcgtctggccaggcggtcggcgtgttcggcctccggaaggacacccaggaccaggttcgtgccgggcgcggtcgggggcatgagggccacgaacgccaacacggcctggggggtcatgcttcccatgaggtaccgcgcggccgggtagcacagcagggaggcgatagggtgccggtcgaaaacaagggtgagggccgggggcggggcttgcgggcccacagcctcccccccgatatgaggagccaaaacggcgtccgtcgccgcataaggcgtgctcattgttatctgggcgctggtcattaccaccgccgcctccccggccgatatctcgccgcggtccagacggtgctgcgtgttgtagatgttcgtcagggtctcggaggcccccagcacctgccagtaagtcatcggctcggggacgtagacgatattgtcgcgcggccccagggcctccatcagctgcgcggaggtggtggtcttccccaccccgtggggtccgtctatataaacccgcagcagcgtgggcagctccggatccccgcgggctccggaggccccctggcgatggctaggacgggacgccgcgcggccgtcggtaggcccgctcgcacgagcagcctgaccgaacgcaggcgcgtgctgttggccggcgtgagaagccatacccgcttctacaaggcgttcgcccgagaggtgcgggagttcaacgccaccaggatttgtggaacgctgctgacgctgatgagcgggtcgctgcagggtcgctcgctgttcgaggccacgcgcgtcaccttaatatgcgaagtggacctcgggccgcgccgcccagactgcatctgcgtgttcgaattcgccaatgacaaaacgttgggaggtgtgtgcgtcatcctggagctaaagacatgcaaatcgatttcttccggggacacggccagcaaacgcgaacagcggaccacgggcatgaagcagctgcgccactccctgaagctgctgcagtcgctcgcgcctccgggggacaaggtcgtctacctgtgtcctattttggtgtttgtcgcgcagcgtacgctgcgcgtcagccgcgtgacccggctcgtcccgcaaaagatctccggcaacatcaccgcggccgtgcggatgctccaaagcctgtccacgtatgccgtgccgccggaaccgcagacccggcggtcgcggcgccgggtcgccgcgaccgccagaccgcaaaggcccccctccccgacacgtgacccggaaggcacggcgggtcatccggccccaccagagagcgaccccccctccccaggggtcgtaggcgtcgctgcggagggtgggggtgtgcttcagaaaatcgcggcgcttttttgcgtgccggtggccgccaagagcagaccccggaccaaaaccgagtgaggttctgtgtgttgtttttttttttttttcctcgttttgttttctcttctttcccccccccctcccccgcttctggccaagcatcctcacctgcttaagcggaacccgcgggcgcgcggggactcatttgtcgccggcgacacccacccgacaacagcccctgggtgtcgaccgctgtcgcccccgtctgtcgcctctcccttttttccccccctcaaagaacgtggtgttgggcgccggccaattcttcccggagcgccgtcgtcgcccgcccgccgccctcgaacatggacccgtactaccctttcgacgcgctggacgtttgggaacacaggcgcttcatcgtcgccgactccaggagcttcatcacccccgagttcccccgggacttctggatgttgcccgtgttcaacatcccccgggagacggcggcggagcgggcggcagtgctgcaggcccagcgcaccgcggccgcggcggccctggagaacgccgccctccaggccgccgagctgcccgtcgacatcgagcgccggatacgcccgatcgagcagcaggtgcatcacatcgccgacgccctggaggcgctggagaccgcggcggccgcggccgaagaggcggatgccgcgcgggacgccgaggcgaggggggagggcgctgcggacggggcagcgccgtcgcccaccgcgggccccgccgccgcggagatggaggttcagatcgtacgcaacgacccgccgctacgatacgataccaacctccccgtggatctgctacacatggtgtacgcgggccgcggggccgcgggttcgtcgggagtcgtctttggtacctggtaccgcacgatccaggaacgcaccatcgcggacttccccctgaccacccgcagcgccgactttcgagacgggcgcatgtccaagaccttcatgaccgcgctggtcctgtctctgcagtcgtgcggccggctgtacgtgggccagcgccactattccgccttcgagtgcgccgtgctgtgtctgtatctgctgtaccgaaccacccacgagtcctcccccgatcgcgatcgcgctcccgttgcgttcggggacctgctggcccgcctgccgcgctacctggcgcgtctggccgcggtaatcggcgacgagagcggacgcccgcagtaccgctaccgcgacgacaagctgcccaaagcgcagttcgcggcggccggcggccgctacgagcacggggccctggccacccacgtcgtgatcgccacgttggtgcgccacggggtgctaccggcggccccgggcgacgttccccgagacaccagcacccgcgtgaaccccgacgacgtggcccaccgcgacgacgtcaaccgcgccgccgccgcgtttttggcacgcggccacaacctcttcctgtgggaggaccagacgctgctgcgggcgaccgccaacaccattacggccctggccgtgcttcggcggctcctcgcgaacggcaacgtgtacgcggaccgcctcgacaaccgcctgcagctgggcatgctgatcccgggagccgtcccggcggaggccatcgctcggggggcgtccggattggactcgggcgccataaaaagcggcgacaacaacctggaggcgctgtgcgttaactatgtacttccgctgtatcaggcagaccccacggtcgagctgacccagttgtttccggggctggccgccctgtgcctggacgcccaggcggggcggccactggcgtcgacgaggcgcgtggtggatatgtcgtcgggcgcccgccaggcggcgctcgtgcgcctcaccgcgctggagctcatcaaccgcacccgcacaaacaccacccctgtgggggagattattaacgcccacgatgccttggggatacaatacgaacagggcctggggctgctcgcccagcaggcacgcatcggcttggcgtcaaacaccaagcgattcgccacgttcaacgtgggcagcgactacgacctgttgtactttttgtgtctcgggttcattccccagtacctgtccgtggcctagggaagggtgggggtggtggtggtggggtgtttttctgttgttgtttctggtccgcctggtcacaaaaggcacggcgccccgaaacgcgggctttagtcccggcccggacgtcggcggacacgcaacaacggcgggccccgtgggtgggtaagttggttcgggggcatcgctgtattcccttgcccgcttccacccccccccccttcccgttttgtttgtttgtgcgggtgcccatggcgtcggcggaaatgcgcgagcggttggaggcgcctctgcccgaccgggcggtgcccatctacgtggccgggtttttggccctgtacgacagcggggacccgggcgagctggccctggacccagacacggtgcgtgcggccctgcctccggagaaccccctgccgatcaacgtagaccaccgcgctcggtgcgaggtgggccgggtgctcgccgtggtcaacgaccctcgggggccgttttttgtggggctgatcgcgtgcgtgcagctggagcgcgtcctcgagacggccgccagcgccgctatttttgagcgccgcggacccgcgctctcccgggaggagcgtctgctgtacctgatcaccaactacctgccatcggtctcgctgtccacaaaacgccggggggacgaggttccgcccgaccgcaccctgtttgcgcacgtggccctgtgcgccatcgggcggcgccttggaaccatcgtcacctacgacaccagcctagacgcggccatcgctccgtttcgccacctggacccggcgacgcgcgagggggtgcgacgcgaggccgccgaggccgagctcgcgctggccgggcgcacctgggcccccggcgtggaggcgctcacacacacgctgctctccaccgccgtcaacaacatgatgctgcgtgaccgctggagccttgtggccgagcggcggcggcaggccgggatcgccggacacacgtaccttcaggcgagcgaaaaatttaaaatatggggggcggagtctgcccctgcgccggagcgcgggtataaaaccggcgccccgggtgccatggacacatcccccgccgcgagcgttcccgcgccgcaggtcgccgtccgtgcgcgtcaagtcgcgtcgtcgtcttcttcttcttcttttccggcaccggccgatatgaaccccgtttcggcatcgggcgccccggcccctccgccgcccggcgacgggagttatttgtggatccccgcctctcattacaatcagctcgtcaccgggcaatccgcgccccgccacccgccgctgaccgcgtgcggcctgccggccgcggggacggtggcctacggacaccccggcgccggcccgtccccgcactacccgcctcctcccgcccacccgtacccgggtatgctgttcgcgggccccagtcccctggaggcccagatcgccgcgctggtgggggccatcgccgccgaccgccaggcgggtgggcttccggcggccgccggagaccacgggatccgggggtcggcgaagcgccgccgacacgaggtggagcagccggagtacgactgcggccgtgacgagccggaccgggacttcccgtattacccgggcgaggcccgccccgagccgcgcccggtcgactcccggcgcgccgcgcgccaggcttccgggccccacgaaaccatcacggcgctggtgggggcggtgacgtccctgcagcaggaactggcgcacatgcgcgcgcgtacccacgccccctacgggccgtatccgccggtggggccctaccaccacccccacgcagacacggagacccccgcccaaccaccccgctaccccgccaaggccgtctatctgccgccgccgcacatcgcccccccggggcctcctctatccggggcggtccccccaccctcgtatcccccagttgcggttacccccggtcccgctcccccgctacatcagccctcccccgcacacgcccacccccctccgccgccgccgggacccacgcctccccccgccgcgagcttaccccaacccgaggcgcccggcgcggaggccggcgccttagttaacgccagcagcgcggcccacgtgaacgtggacacggcccgggccgccgatctgtttgtgtcacagatgatggggtcccgctaactcgcctccaggatccggacttggggggggtgtgtgttttcatatattttaaataaacaaacaaccggacaaaagtatacccacttcgtgtgcttgtgtttttgtttgagaggggggggtggagtgggggggaaagtgggccgaatgacacaaaaattaggtcggaggggtgaggggggggggctaggagccgaaccgatggcccccacacgcgacggaaggcccggaagactaccacggggagggggtgtggaaagcgaccggtcgcagggagacggggttggtttggggttggtttggggttggttttcccgttagcacatgtctgcatttgtttttctagtcacacgccccccccccccaaataaaaaccaaggcaaaacaataccagaagtcatgtgtatttttgaacatcggtgtctttttatttatacacaagcccagctcccctcccctcccttagagctcgtcttcgtctccggcctcgtcctcgttgtggagcggagagtacctggctttgttgcgcttgcgcagaaccatgttggtgaccttggagctgagcagggcgctcgtgcccttctttctggccttgtgttccgtgcgctccatggccgacaccaaagccatatatcggatcatttctcgggcctcggccaacttggcctcgtcaaacccgcccccctccgcgccttcctccccctccccgcccacgcccccggggtcggaagtcttgagttccttggtggtgagcggatacagggccttcatgggattgcgttgcagttgcaggacgtagcggaaggcgaagaaggccgcgaccaggccggccaggaccagcagccccacggcaagcgccccgaaggggttggacataaaggaggacacgcccgagacggccgacaccacgccccccactactcccatgactaccttgccgaccgcgcgccccaagtcccccatcccctcgaagaacgcgcacagccccgcgaacatggcggcgttggcgtcggcgcggatgaccgtgtcgatgtcggcaaagcgcaggtcgtgcagctggttgcggcgctggacctccgtgtagtccagcaggccgctgtccttgatctcgtggcgcgtgtagacctccaggggcacaaactcgtggtcctccagcatggtgatgttcaggtcgatgaaggtgctgacggtggtgacgtcggcgcgactcagctggtgagagtacgcgtactcctcgaagtacacgtagcccccgccgaagatgaagtagcgccggtggcccacggtgcacggctcgagcgcgtcgcgggtgaggcgcagctcgttgttctcgcccagctgcccctcgatcagcgggccctggtcttcgtaccgaaagctgaccagggggcggctgtagcacgtccccggccgcgagctgacgcgcatcgagttctgcacgatcacgttgtccggggcgacgggcacgcacgtggagacggccatgacgtctccgagcatgcgcgcgctcacccgccggccgacggtggcggaggcgatggcgttggggttgagcttgcgggcctcgttccagagagtcagctcgtggttctgcagctcgcaccacgcgacggcgatgcgccccagcatgtcgttcacgtggcgctgtatgtggttatacgtaaactgcagccgggcgaactcgatcgaggaggtggtcttgatgcgctccacggacgcgttggcgctgggcgcctcccgcagtggcgcgggcgtggcattccggggcttgcggtcctgctcccgcatgtactcccgcacgtacagctcggcgagcgtgttgctgaggaggggctggtacgcgatgaggaagccccccgtggccaggtagtactgcggctggcccaccttgatgtgcgtggcgttgtacttgcgcgcaaacatgcggtcgatggcctcgcgggcatcccggccgatgcagtcgcccaggtcgacgcgcgagagcgagtactcggtcaggttggtggtgaaggtggtcgagatggcgtcggaggagaagcggaaggagccgccgtactcggcgcggagcatctcgtccacctcctgccacttggtcatggtgcagaccgccggtcgcttcggcacccagtcccaggccacggtaaacttgggggtcgtcagcaagttgcgggtcgtcggcgacgtggcccgggccttcgtggtgaggtcgcgcgcgtagaagccgtcgacctgcttgaagcggtcggcggcgtagctggtgtgctcggtgtgcgacccctcccggtagccgtaaaacggggacatgtacacaaagtcgcccgtcgccagcacaaactcatcgtacgggtacaccgaccgcgcgtccacctcctcgacgatgcagttgaccgtcgtgccgtaccgatggaacgcctccacccgcgaggggttgtacttgaggtcggtggtgtgccacccccggctcgtgcgcgtggcgaccttcgccggcttgagctccatgtcggtctcgtggtcgtcccggtgaaacgcggtggtctccatgttgttccgcacgtacttggccgtggagcggcagacccccttggcgttaatcttgtcgatcacctcctcgaagggaacgggggcgcggtcctcgaatatccccataaactgggagtagcggtggccgaaccacacctgcgacacggtcacgtctttgtagtacatggtggccttgaatttgtacggggcgatgttctccttgaagaccaccgcgatgccctccgtgtagttctgcccctccgggcgcgtcgggcagcggcgcggctgctcaaactgcaccaccgtggcgcccgtcgggggcgggcacacgtaaaactgggcatcggcgttctcgaccttgatttcccgcaggtgcgcgcgcagcgtggcgtggccggcggcgacggtcgcgttggcgtcggggggcggggtcgcctcgggccgcttgggcggctttttggttttccgcttccgggccttggtggtcgcggggctcgggacggggggcggccgggaggcgggacccccgttcgccgcgacggtcgcggccacgccgcccgaggcgcggggggccgccggggccgccggggccgccgacgccaccgcggccaccagcgcccccacgaccagcgcgcaaatcaagccccccccgcgcatggcgggcctacgggggcgcgtcgctcccgccgcccgctagtctgggggcgaggtgctgcaggaccgagtagaggatggaaaaaacgtctcggtcgtaaaccacgaccgagcggggtccgatgcagccgtcggggccgctctcgacgatggccaccagcggacagtcggagttgtacgtgaggtacacgcccggcgggtagcggtacagaccttcggaggtcgggcggctgcagtcggggcggcgcaactcaagctccccgcaccggtagaccgacgcaaagagtgtggtggcgataatgagctcgcgaatatatcgccaggcggcgcgctgggtgggcgtgattccggaaacaccgtcaaaacagtagaacttttgaaactcgctgacggcccaatcagcgcccgaaccccccgcgcccatgatgaagcgggcgagttcctccttgaggtgcggcaggagccccacgttctcgacgctgtagtacagcgcggtgttggggggctgggcgaagctgtgggtggagtggtcgaacaggggcccgttgacgagctcgaagaagcgatgggtgatgctggggagcagggccgggtccacctggtggcgcagcagcgacgctcgcatgaaccggtgcgcgtcaaacacgcccggggcggcgcggttgtcgatgaccgtgcccgcgcccgccgtcagggcgcagaagcgcgcgcgcgccgcgaagccgttggcgaccgcggcgaaggtcgcgggcagcacctcgccgtggacgctgacccgcagcatcttctcgagctccccgcgctgctcgcgcacgcagcgcccgaggctggccagcgaccgcttggtcaggcggtccgcgtacagccgccggcgctcccgcacgtccgcggcggcccgcgtcgcgatgtcgccccagctctccggcccctgcgcccctggctcggggccgcgctccccgtcctcgctcgcgggcgtccccgcgccacgcctccgccccccctcctccgcggcggcccggggctcttcctcctcggcccccccggtcgcgccgccggcccccagccgcgccagcacgcggcgcagcgcctcctcgtcgcactgctcggggctgacgagccgccgcagcagcggcgtcgtcaggtggtggtcgtagcacgcgcgtatcagcgcctcgatctgatcgtcgggcgacgtcgcctggccgccgatgatcagggcgtccaccatgtccagcgccgccaggtggcccccgaacgcgcgatcgaagtgctccgcccgccgcccgaacagcgccagctccacggccaccgcggcggtctcctgctgcagctcgcgctgcgccagcgcgttcaggttgtcggcgaaggcgtccatggtggagtggcgggcgcgatcgccggacgccagccagaagcgcagctcgctgatggcgtacaggccgggcgtagtggcctgaaacacgtcatgcgcctccagcagggcgtcggcctcctcgcggacagaagagctatcggcgggcggcgggccggcccgggccccgccgcccgccgcggtccgcgccagcgcctggtccagcacacagagcgctcgcgcgcgggcggcgtccgacagcccggcggcgtggggcaggtaccgtcgcagctcgttggcgtccagccgcacctgggcctgttgggtgacgtggttacagatgcggtccgccaggcggcgggcgatggtcgccccctggttcgcggtgacgcacagctcctcgaaacagaccgcgcacgggtgggacgggtcgctcagctccgggggcacgatgaggcccgaccccaccgccgccaccataaactcccggacgcgctccagcgcggccgtggcgccgctcgggggggtgatgaggtggcagtagttcagctgcttgagaaaattctcgacatcatgcaggaagcacagctccatgcggacgtccccgccgtacgtctgcagccggatctgctggtggtacggacagggtcgggccagacccatggtctcggtgaaaaaggcagagacgtcacccgtggtcgcgaacgtttccaggtggcccaggagccgctccccctcgcgccacgcgtactccaggagcaactccagggtgaccgacagcggggtgagaaaggcggcggcctgagcctccagccccggccgcaggtgccgccgcagcacgcgcacctggagcgcgttgagctttagctgggcgagcttccccaggccgatctgggggtcgcatcgtcgaagcagctctagctgaaaaacgtacgtctgtacctgcccgagcagggccaacagtttctgtcgggccgcagtgggctcggaaaccgcggccgggggcgcggccgccatggcgagtcacccggccgtgctgtggtttagttaaggtttgggggggggtgggtcagaggcgcgccccgcgcggactgatgcggcggcgggcccctgacatcccctctttatgcccgtcgcccgcccgcccgccccgccggtgtgccgtgattcgcggagtcggggccttgtgtttctttctttcccccccgaatccgttctttcttcctcacccccccctccccacacacccacccaggactcgccaccacaaggaggcgagagcccgtcgctaacccaaagacacagtcacgagacacgatatcgactgtagttgcgatcgtttattttatacacaacaccaacctttccttcgaccccccccacccccgcccctagagcatatccaacgtcaggtcctttttctccggtggtccctccccaaacggatcgtcgccgtgaaacgcccgctttcgggcgacgccggccgcccccgccgccgccgccaaaccgccgaacgacgccgcgtggtcatcctcgtcgccgaaatccccaaagttaaacacctccccggcggcgccgagctggctgaccagggcctccgcctcgtgggccacctccagggccgcgtcggtcgaccactcgccgtgcccgcgctccagggcgcgggtggtaaactccatcatttcctcgctcaggtactcgtcctccagcagcgccagccagtcctcgatctgcagctgctgggtgcgggggcccaggctcttgacggtcgccacaaacacgctgctggcgaccgccgccccgccctccgcaatgatgccccggagctgctcgcacagcgaatgctcgtgggccccgcccccgagactcgacgccgcgcacacaaacccggccctggggcaggccaggacaaacttgcgggtgcggtcaaagatcagcagcgggcacgcgtttttgccgcccagcaggctggcccagttcccggcctgaaacacgcggtcgttgccggccatgccgtagtatttgctgatgctgaggcccagcacgaccatcgggcgcgcggccatcacgggccgcagcaggttgcagctcgcgaacatggacgtccaggcgccggggtgcgcgtcgagggagtccatcagcgcgcgggccccggcctccaggcccgcgccgccctgcggggcccaggcggccgccgcctgcacgctggggggacggcgggacccggcgatgacggccgtgagggtgtttatgaagtacgtcgagtggtcgcagtacctcaagatctggttggccatgtagtacatggccagttcgctcacgttattgggggccaggttgataaagttaatcgcgccgtagtccagggagaacctcttaatgaacgcgatggtctctatgtcctcgcgcgacaagagccgggcggggagctggttgcgctggagggcggtccagaaccactgcgggttcggctggttcgaccccgggggcttgccgttgggaaagatgaccgcgtggaactgcttcagcaggaagcccagcggtccgaggaggatgtccacgcgcttgtcgggcttctggtaggcgctctggaggctggcgacccgcgccttggcggcctcggacgcgttggcgctcgcgcccgcgaacaacacgcggctcttgacgcgcagttccttgggaaacccaagggtcacgcgggcaacgtcgccctcgaagctgctctcggcgggggccgtctggccggccgttaggctgggggcgcagatagccgccccctccgagagcgcgaccgtcagcgtcttcgccgacaggaacccgttgttgaacaggtccatgacgcgccgccgcagcaccggttggaattgattgcgaaagttgcgcccctcgaccgactgcccggcgaacaccccgtggcactggctcagggccaggtcctggtacacggcgaggttggaccgccgcgcgaggagctgcagcagggggcacggcccgcaggtgtacgggtccagcgacagcgacatggcgtggttggcctcggccagaccgtcgcggaacttaaagttgcgcccctcgatcaggttgcgcatcagctgttccacctcgcgatccaccagctgcttgatgttgttcaccaccgtgtgcagggcctcgcggttgccgataatcgtctccagcctccccagggccgtgggcaccgcctggtccacgtactgcagggcctcgagctcggccatgacgcgctcggtggccgcgcggtacgtctcctgcatgatggtccgggtgttctcggacccgtccgcgcgcttcagggccgagaaggcggcgtagttccccagcacgtcgcagtcgctgtacgcgctgttcatcgttccgaagaccccaatggccccccgggcggcgctcgcgaacttggggtggcgggcccgcagccgcatcagcgtcgtgtgcgcgcaggcgtggcgggtctcgaaggtacacaggttgcagggcacgtcggtctggcccgagtccgcgacgtagcgaaacacgtccatctcctggcgcccgacgatgactccgccgtcgcagcgctccaggtaaaacagcatcttggccagcagggccggagagaacccgcacagcatggccaggtgctcgccggcgaactcctgggttccgccgacgaggggcgccgtggggcgcccctcgtacccgggcaccacgtggccctcgcggtccagctgcgggttggccgccacgtgcgtgccgggcacgagaaagaagcggtaaaaggagggcttgctgtggtccttggggtccgccggcccggcgtcgtccacctcggtcaggtggagggccgaattggtgctgaacaccatggcgcccacgaggcccgcggcgcgcgccaggtacgccccgacggcgccggcgcgggccgcgggcgtttcctggccctcaagcaggggccacgtggtgatgtcggggggcggctcgtcaaagaccgccatcgacacgatggactccagggccagggcggcgtcgcccgccatcaccgaggccaggcgctgctcaaacccgcccgccgggcccttgttcccggcgtcgcgcgcgccccgctggggcttaccctggctggcctcgaaggccgtgaacgtaatgtcggcggggagggccgcgccctcgtggttttcgtcgaacgccaggtgggcggccgcgcgggccacggcgtccacgttccgggcacgcagggccacggcggcgggcccgacgaccgcctcgaacagcaggcgggcgagggggcggttgaaaaacggaagggggtagttgaaattctccccgatcgatcggtggttgcagttaaacggatcggcgatgacccggctaaaatccggcataaacatctgcagcggatacacggggatgcggtgaacctccgcgtccccgatggttaccttgtccatcccgcccagatgcaggaaggtgttgctgatgcacacggcctcccggaagccctccgtgatcaccagatacagcaaggcccggtccgggtccagtccgagccgctcgcacagcgcgtcccccgtcgtctcgtgctttaggtcgcagggccggggcgcgtagtccgcgaagccaaaatggcggcgcgcccgctcgcagagccgcgtcaggttgggggcctgggtgctgggggccaggtggcggccgccgtgaaagacgtaaacggacgggctgtagtgcgagggcataagcttgagggacaccgcggtccccccaaggcccgtcgtgcgggacccgacgaccgcggccacgttggcctcaaacccgctctccacggtcaggccgacgatgaggggcgcgacggcgacgtccgcgtcgccgctgcgcgccgacagtagcgacagcagctccaggccttcggccggacaggcgcggccatacacgtaccccatcggccccggaggaaccttgacggtggtcgtcgttttgggcttggtgtccatggctttcgggagatcggcgaccggcaggaacgggggcccggcaagacgaccgggggcagacgggggaggccgcgcgtggtcgacggctgctgcccgccgtcgtctctccgatggggtcgaatgccggcgctgggggtggggtctacacccgcccgttcgccgagcggcccctggtgggggtgggatgggtgggatggggtgggcgagaatggcccgccaccggatcgcgccggacgggggggcccggggttgggcaaggtttgggcgcaaggctccagcggcgattcgagaggcctgcggatggcggcccagagctgggtatgctcggccggggcggccggtatatgtacggcgtgctgggaggggcggcgtcgggccccgcccacggtccgccacgccccgcgcgtcatcggcagggggcgtggccgcccttctaaaaaaagtgagaacgcgaagcgttcgcactttgtcctaataatatatatactattaggacaaagtgcgaacgcttcgcgttctcactttttttagaagggcggccacgccccctttgacgtcacgctcacccgggcggccggccgcccataagcgcggcctgccgggccgataaaaagaaaccgcggcgcccccgcggacaccacacactggctctcgaaccccggacgcgcagaagggacccgggcgcgggtccgccggtaagagccggggggaacatcggcaccgccatcccaccccgagctgttgggtgggcgggtgggggggctggtgaggcggtggtgggagggggcggcgtatagcaggacaacgaccggcggcgatgttttgtgccgcgggcggcccggcttcccccggggggaagccggcggctcgggcggcgtctgggttttttgccccccacaacccccggggagccacccagacggcaccgccgccttgccgccggcagaacttctacaacccccacctcgctcagaccggaacgcagccaaaggccctcgggccggctcagcgccatacgtactacagcgagtgcgacgaatttcgatttatcgccccgcgttcgctggacgaggacgcccccgcggagcagcgcaccggggtccacgacggccgcctccggcgcgcccctaaggtgtactgcgggggggacgagcgcgacgtcctccgcgtgggcccggagggcttctggccgcgtcgcttgcgcctgtggggcggtgcggaccatgcccccgaggggttcgaccccaccgtcaccgtcttccacgtgtacgacatcctggagcacgtggaacacgcgtacagcatgcgcgccgcccagctccacgagcgatttatggacgccatcacgcccgccgggaccgtcatcacgcttctgggtctgacccccgaaggccatcgcgtcgccgttcacgtctacggcacgcggcagtacttttacatgaacaaggcggaggtggatcggcacctgcagtgccgtgccccgcgcgatctctgcgagcgcctggcggcggccctgcgcgagtcgccgggggcgtcgttccgcggcatctccgcggaccacttcgaggcggaggtggtggagcgcgccgacgtgtactattacgaaacgcgcccgaccctgtactaccgcgtcttcgtgcgaagcgggcgcgcgctggcctacctgtgcgacaacttttgccccgcgatcaggaagtacgaggggggcgtcgacgccaccacccggtttatcctggacaacccggggtttgtcaccttcggctggtaccgcctcaagcccggccgcgggaacgcgccggcccaaccgcgccccccgacggcgttcggaacctcgagcgacgtcgagtttaactgcacggcggacaacctggccgtcgagggggccatgtgtgacctgccggcctacaagctcatgtgcttcgatatcgaatgcaaggccgggggggaggacgagctggcctttccggtcgcggaacgcccggaagacctcgtcatccagatctcctgtctgctctacgacctgtccaccaccgccctcgagcacatcctcctgttttcgctcggatcctgcgacctccccgagtcccacctcagcgatctcgcctccaggggcctgccggcccccgtcgtcctggagtttgacagcgaattcgagatgctgctggccttcatgaccttcgtcaagcagtacggccccgagttcgtgaccgggtacaacatcatcaacttcgactggcccttcgtcctgaccaagctgacggagatctacaaggtcccgctcgacgggtacgggcgcatgaacggccggggtgtgttccgcgtgtgggacatcggccagagccactttcagaagcgcagcaagatcaaggtgaacgggatggtgaacatcgacatgtacggcatcatcaccgacaaggtcaaactctccagctacaagctgaacgccgtcgccgaggccgtcttgaaggacaagaagaaggatctgagctaccgcgacatccccgcctactacgcctccgggcccgcgcagcgcggggtgatcggcgagtattgtgtgcaggactcgctgctggtcgggcagctgttcttcaagtttctgccgcacctggagctttccgccgtcgcgcgcctggcgggcatcaacatcacccgcaccatctacgacggccagcagatccgcgtcttcacgtgcctcctgcgccttgcgggccagaagggcttcatcctgccggacacccaggggcggtttcggggcctcgacaaggaggcgcccaagcgcccggccgtgcctcggggggaaggggagcggccgggggacgggaacggggacgaggataaggacgacgacgaggacggggacgaggacggggacgagcgcgaggaggtcgcgcgcgagaccgggggccggcacgttgggtaccagggggcccgggtcctcgaccccacctccgggtttcacgtcgaccccgtggtggtgtttgactttgccagcctgtaccccagcatcatccaggcccacaacctgtgcttcagtacgctctccctgcggcccgaggccgtcgcgcacctggaggcggaccgggactacctggagatcgaggtggggggccgacggctgttcttcgtgaaggcccacgtacgcgagagcctgctgagcatcctgctgcgcgactggctggccatgcgaaagcagatccgctcgcggatcccccagagcacccccgaggaggccgtcctcctcgacaagcaacaggccgccatcaaggtggtgtgcaactcggtgtacgggttcaccggggtgcagcacggtcttctgccctgcctgcacgtggccgccaccgtgacgaccatcggccgcgagatgctcctcgcgacgcgcgcgtacgtgcacgcgcgctgggcggagttcgatcagctgctggccgactttccggaggcggccggcatgcgcgcccccggtccgtactccatgcgcatcatctacggggacacggactccattttcgttttgtgccgcggcctcacggccgcgggcctggtggccatgggcgacaagatggcgagccacatctcgcgcgcgctgttcctccccccgatcaagctcgagtgcgaaaaaacgttcaccaagctgctgctcatcgccaagaaaaagtacatcggcgtcatctgcgggggcaagatgctcatcaagggcgtggatctggtgcgcaaaaacaactgcgcgtttatcaaccgcacctccagggccctggtcgacctgctgttttacgacgataccgtatccggagcggccgccgcgttagccgagcgccccgcagaggagtggctggcgcgacccctgcccgagggactgcaggcgttcggggccgtcctcgtagacgcccatcggcgcatcaccgacccggagagggacatccaggactttgtcctcaccgccgaactgagcagacacccgcgcgcgtacaccaacaagcgcctggcccacctgacggtgtattacaagctcatggcccgccgcgcgcaggtcccgtccatcaaggaccggatcccgtacgtgatcgtggcccagacccgcgaggtagaggagacggtcgcgcggctggccgccctccgcgagctagacgccgccgccccaggggacgagcccgcccccccagcggccctgccctccccggccaagcgcccccgggagacgccgtcgcatgccgaccccccgggaggcgcgtccaagccccgcaagctgctggtgtccgagctggcggaggatcccgggtacgccatcgcccggggcgttccgctcaacacggactattacttctcgcacctgctgggggcggcctgcgtgacgttcaaggccctgtttggaaataacgccaagatcaccgagagtctgttaaagaggtttattcccgagacgtggcaccccccggacgacgtggccgcgcggctcagggccgcggggttcgggccggcgggggccggcgctacggcggaggaaactcgtcgaatgttgcatagagcctttgatactctagcatgagccccccgtcgaagctgatgtcccgcatcttgcaataaatgtctgcggccgacacggtcggaatttccgcgtccgctggtttctctgcgttgcgtctgaccacgagcacaaacgtgctctgccacacgtgggcggcgaaccggtagccggggcacgcggtcagcatccgatcgatgagccggtagtgcaggtgggccgacgtgccggggaagatgacgtacagcatgtggcccccgtacgtggggtccgggtaaaaaagaaaccgggggtcgcacgccccccctccgcgcaggatcgtgtgcacgaaaaagagctcgggctggccgagcgtatcggccaggaggtcctggaggggggtgctgtggcggtcggccagcacgaccagggaggccagaaaggtgcggtgctcaaagatcgtattgatctgctgcacgaaggccaggatgagggcctcgcggctgacggtggccagccgcccgtcgcccgcgctgcacgcggggcagcagcccccgatccccaggtagtagcccatgcccgagagggtcaggcagttgtcggccacggtctggtccaggctgaaggggagcgacacgggggtcgtcttcaccaggggcacggagagcgagcgcacgatggcgatctcctcggagggcgtctgggcgagggcggcgaagaagccgcggtagcgacggcgctcgtgcaggcagagctccagcctgcgcgcgtgcgacggcaggctcttgcgggaggcccggcgctccacgccggggttcccggcggcggaaaagcgcgaccgccgccgggtcttgtcgcggccgggcccgggccgggagccggagcgacggggggcgatgtcatacataggtacagagggtgtgctccagggacaggagagagatcgagtgtcgtctgagcagcgcgccggcctcgcggacaaatgtggccagcgcggtgggcttcggcacaaatacctggtacgtcttgaaggtgtagatgagggcccgcagggctatacagacccgcccctcgaactcgttgccgcaggccaacttggccttgtgaagctgcagctcgtcgcgatggtcggcgcgggggtggccaaacaggacccaggggtcgacttccatctccgtgatggcgcacatcggatcgcagaacatgtgcttgaagatggcctcggggcccgcggcccgaagcaggctcacgaaccggcccccgtccccgggctgcgcctcggggtccgcctcgagctggtccacgaccggcactatgcagtcgaagaggctggtgttgttctccgagtagcggacgacggacgccctcaggcgtcgcatggccagccagtaggcccgcaccagcaacagattgcacagcaggcattccccgccggtgcgcccgcggccccggccgtgcttcagcacggtggccatcagcgggcccaggtccaggtcgggctgggcctggggctcggcgaactgcgcaaaacgcggggccgcgtcgcgcatgcgcgccccgcggtgcgcttcccaggactcgctgaccgcggcgcggcgggcgtccgcggcggcgcgcagccggggccccgactcccagacggcgggggtgccggcgagcagcagcaggatcaggtcggcgtacgcccacgtctccggctcacccccctgcgccagcgccccggcggcggcctcgaactccccgttgcgggcggcggcgcgcgtgcagcagctgtctccgcccccgcgcttgccctcggtgcagtcgagcaggcgggcgcagtccttccagttcatcagggcggtggtgagggagggttgcgttcccgagcccccgcccgcccccgcccccgccccgtcatcgcccccggaggccagggtcccgatgagggcccgggttgcggactgcgcgaggaaggaatagttggagtactgcaccttggcggcgcccggggagggcgtcggcctgggttgcttctgggcgtggcgcccgggcaccccgccgtcggtccggaagcagcagtggagaaagaaatgccggtggatgtcgttgatggtcagggcgaagcgcgcgaaggagccgacaagggtcgccttcttggtgcgcaggaagtggtggtccatgacgtagacgaactcgaaggcggccacgaagatgctcgcggcgcagtggggcgcgcccaggcacttggcgcagaggaacgcgtaatcggccacccactggggcgagaggcggtaggcctgcttgtacagctcgatggtgcggcagaccagacaggggcggtccagcgcgaaggtgtcgacggacgccgcggcgaagggccccgtgtccaagagtccctctgccgtggggtctgcgggcgggccgcgggcggaccccggcccccgcccccccgaagcctcgcgcgcggccccgcgcggccgcgggggggcgggcgcgacgtcgctctccacgtcctcgtcgagcgcgctcgcgggcggcacgcctaccacgtgacaggccgccaggagctcggcgcacagggcctcgttaagagccagaaggtcgggatcgaaggccacatacggacgctcgaacgcgccctccttccagctgctgcccggcgactcttcgcgcacggcggcgctcgacggcacccccggggcggacgtcgccatggccggtcgagcggggcgcacgcgtccgcgaacgttacgggacgcgatccccgactgcgcgctgcggtcccagaccctggaaagtctagacgcgcgctacgtctcgcgagacggcgcgggggacgcggccgtctggttcgaggacatgacccccgccgaactagaggttatattcccgaccacggacgccaagctgaactacctctcgcggacgcagcggctggcctccctcctgacgtacgccgggcctataaaagcgcccgacggccccgccgccccacatacgcaggacaccgcgtgcgtgcacggcgagctgctcgcccgaaagcgcgaacggttcgcggcggtcattaaccggttcctggacctgcaccagatcctgcggggctgacgcgcgcttcggcggggcaccggcaccgggaccgacttgttttacataacagtagggggtgggggaacgcgcacccttgcccggtcgcgatggcggggatggggaagccctacggcggccgcccgggggacgcgttcgagggtctcgttcagcgcatcaggctcattgttcccgccacgctgcgcggcgggggtggggagtcgggcccctactcgccatccaacccgccctcgagatgtgccttccagttccacggccaggatgggtccgacgaggccttcccgatcgagtacgtcctgcggctcatgaacgactgggccgatgtgccctgcaacccctacctgcgcgtgcagaacaccggcgtttcggtgctgtttcaggggttttttaaccggccccacggcgccccggggggcgcgatcacggcggagcagaccaacgtgattctgcactccaccgagacgacgggactgtccctcggagacctggacgacgtcaaggggcgcctcggcctggacgcccggccgatgatggccagcatgtggatcagctgctttgtgcgcatgccccgggtgcagctcgcgtttcggttcatgggccccgaggacgccgttcgcacgcggcggatcctgtgtcgcgccgccgagcaggccctcgcccgtcgccgccggtccaggcggtcccaggatgactacggggcggtggtggtggcggcggcgcaccactcttccggagcgcccgggccgggggtcgccgcctcgggcccgccagcgccgcccggacggggaccggcccgtccgtggcatcaggccgtgcagttgttccgggccccgcgtccgggccccccggcgcttctgttgctggcggcggggctgtttctgggggccgctatctggtgggcggttggcgcgcgcctatgaaagggggcgagccaccgtcccgcccgccagtgcatcccagacgcccgcgagccgcacatcccctccgctcccgcctccggcccgattcttacggcgcgacccaaggtcccgatggccgccccgcagtttcaccgccccagcaccattaccgccgacaacgtccgggcgctcggcatgcgcgggctcgtgttggccaccaacaacgctcagttcatcatggataacagctacccgcatccgcacggaacgcagggtgcggtgcgagagtttcttcgcgggcaggccgcggcgctgacggacctcggggtgacccacgccaacaacacgttcgccccgcagcctatgttcgcgggcgacgccgcggccgaatggctgcggccctcgttcggtcttaagcgcacgtattccccctttgtcgttcgcgaccccaagacccccagcaccccgtgagtcctcggcgggtccctccgcggccgtctctcgttgcccccctttcccccttcccgggtggttcaataaaaaacaccaacatacgatattcgcgtttgatacgtttattggggggggtgtagggcccaacgatcggcgattaacaacaccaaacaatcgagcgcgtctaacccagtaacatgcgcacgtgatgtaggctggtcagcacggcgttgctgcgctgaaacagcgccctgcgggtccgctgcagctgttgttgtatgcggcggcatgcgcggatcaaaaccgccagggcgctacgaccggtgcttcgtacgtagcgtcgcgacaagacggcatttgcctgtacgggcaaggggccaaattgcgagtgtggtgactggaggtggtcggcggccaatgggccgggtggttcgtcggcggggggcaagtgcggttccggtgggagggggtcgagcgcctcggtatcatccgagtccgagaaacgcagggagtctgcgtcggagtgttcatcatcggaggagatgtgcagcgtctgaagcagcgatgcgggtgggggcgcggagtcgacgtgaagcgcgagagaggaagcccacgaagtcacagcggacactgggaggtgggtgtttgtatgtgtgggagactcgggcgtcgggaccgagtctcggctctggggtgtaagcgtccgagttacgggcggcaggggcggctggggcaggggcggctggggcaggggcggctggggcaggggcggctggggcaggggcggctggggcaggggcggctggggcaggggcggctggggcaggggcggctggggcaggggcggctggggcaggggcggctggggcaggggcggctggggcaccgagcgcgcgcggatgcgcgtccgcgcggcgggtttggtcgcgggtgactggggtggggggcggcgggcaaccgggcctccgggcacgacccaaccgcacaaaggctcgctcggggcaaccgggcctggggccaaaggcggggggctggtctggacggcggaggtcgggggggcaaggcccggagaaggcggcactgccgccgctgcggcggaaaccgcggccgcgtggtcggctgggtcccggggagaggggagggagttcaacgaggccgagagcgaggcgaccgcggggcgcgtgaggcgccggggtgggccggccgcggggccccgggggggtgtcggcgagggacccgctgttgtctggcggcggccgcggcggcggtcgcccccggggacgaccgctccttcggcgggcggaggcgggatgggcgcgagcgtgggggcgggaaaggccccgcgagccgaggcggggccgggcggaaggggcaaagcagaaacccaagccgggggcgcggactccggggtgggcggctggtcgggaggacgcgcggaagcggcgaccggggcgaccggggcggggagtgccggcggacgccacccctcggggggggcggaggcccggggcgcgcgcgatttggcacgcgtccggcgggacctgcgcacgcgcggcacggcggcggagaaagcggcggcagagccggaaaaggccgggggaggaagcgcggcatccgcggggggactcggtgtgggtggcgagggccgtgggtcgtcgcgaggggccacgggcacgcgccccgtgttttgttgaggcgggacactcggtcgtgtttcgcgagccgtagctgccggcccgatgggccgcggtgcgtactgggacgtggggacggactgatcggtggcgggggggggaagaagggccggggccggattgggcgtggggccgccggcgtcgtcggacgccagctcctccaggccgtggatccaggcccacatgcgaggggggacgggctcgccggtggtggcgtcggtgaggagagtgggggcgaggacccccgggtccgcctgccgtgcggggggggcagcggggtcctcgggacccgatccgccatccccccccgcaaggtcccgcgggtcgcgggcggcggtcggggcagagggacctgcctcgtcggcgagggggcgctggtaaaccgggtgtcccgggaacagctcccccgtcaggagggaggcgtcgaagggccgcccgaggatggcccgcgcgaagaaggggtccgcgtcggcggcgctcgccgcgagaacgtcccccgcggtagccacaaacggaagctcctcggtggcctcgctgcccacaaaccgcacgtcaggggggccggggggctccggggcttcccacaagaccgcgaccggggtcatggagatgtccacgaggaccaggcacgggggcccgtcggcgagagggcgctcggcgatgagcgccgacaggcgcgggagctgcgccgccagacacgcgttttcgatcgggttgagatcggtgtggaggaggccgacggcccacgtctcgatgtcggacgacacgacgtcgcgcagggcggcgtccggcccgccggggcgcgagtcgaagagcgtcaggcacagttccagttccgactcgcgggagaaggccgtggtgttgcggagcgccaccacgacgggcgcgccgaggagcaccgcggccagaaccaggtccatggccgtaacgcgcgcggcgggggtgcggtgggtcgcggcggccagcacggccacgtgctggcccgtgggtcggtagagggcgtggggggcctcggggagggacgccttgcgcccccccgccgggccgagcgtctggccagactccaggcgtgcggccaggagggcgtcgaagctgtcgtactcggtgtagtcgtcgggaaacatgcaggtccacagcgcggccaaagcggcgctcggcagacacatgcgcccgaggacgctcaccgccgccagggcctgggccggactgagcttcccgagcgccgggacgtcccggcgctgggtcccgagctccaaggccgagcgccagggcgccagcgggtcggtttcggacagcttgccccggcgccagtcggccagccgcgtgccgaacaggaggccccgggtcggggggcctccgtccaaaaacgtcggcaacacgcggatgcgggcgtcgggatgcggggtcaggcgctggacgaacagcatggactccgctgcgtcctcgaacgcgcgttcgagggtgaggtgcatgtactcgtgctggcgaacgaggtccaggcgccagaagttgtagatgtgttccggaacgccggccaccagcgcgaccagcacgtcgttctcgttgaaggcgacgcagtggcgctgggacccccgggggcccggcggcggacgcggcgccgccgctccggacgcccagcccagctgggcccagcgacacccaaactcgcgcgtgagggtggtggcgacgagggcgacgtacagctcggccgccgcgtccatcgaggcgccccacgtcgcctggcgatggcgcacgaagcgaccgaacagctgaaagttggcggcctgggcgtcgctgagggccagctggagccggttcacgacggtcagcacgtacatggccgtgaccgtcggggccgattcgaggacgtccgtcggaagcgggggccgcacgcaggccgcctcgggacgcatcagcagcgcgccgagtttgtcggtgacggccgggaagcatagcgcgtactgcagcggcgttccgtccggggccaaaaagctggtggcgaacggcagatccagagcgctgacggcctcacgcagcaccaggggccccgggtctccgccggcgcgcagatacgcctcgccccggcggcgcagcagctgcgggtcgacctcgtggccctcgggggaagaagaggcccgggcgcgggcgtcgagggcgcgaagatcaacgagcaggggcgcgggcgcggactccgcgcccgcgcccgtctggccgccggccctggcgtacgcgctatataagcccatgcggtattggatgagttcccgcgcgccccggaactcctccaccgcccacggggccaggtccgcggccgccgcgtcgaactccgccagcaggcgccccagggcgtcaaagttcatctcccagggcaccctgcgcaccacctcatcccgcagccgggcgcacagggcggtgtgcttggtgacgcgcgcgcccagctcctccacggcctccgcgcgctcggcgcccttggcgcccaggacgccctggtacctggcggaaaggcgctcgtaggccggctgggcccgcagccccgacaccgtgttggtggtgtcctgcagggcgcgcagctgctcgtgcatggcgcggaacccctcgggggacttccaggcgcccccccggacgcggccaaagcgaccccagacctcgtcccactccgcctcggcctcctccagggacctccgcagggcgtcgacgcggcgccgagtatcaaagagcgcccccaggcggccggcgtgccgcgccagggggccggggccgtcgccgcgggcggcgcttagcgggtgcgtctcgaaggtgcgctgggcgtgctctagccagataaccgcgggcacgtcgagctcgcgcgttttctcggtctgatccaacagaacctcgacctggtcggcgatctccgccaccgagcgcgcctggtcgagcgtcttggccacggtcgccgggacggcgaccaccttcagcatggtcttgaggttggccaggccctcggcctcgatctgggcccggcgctcgcgcgcggccagcgcctcccgcaggcccgccatgacccgctcggtggcctccgcgcgctgctgtttggcgcgcaccactgcgtccttggtctcggccgtgtcctgccgggtcacgaaggcgacatactcggcgtacgccgtgttcttcacggggctctggtccacgcgctccaacgccgccgcgcacgcgaccagcgcgtcctcgctgggacacggcagggtgaccccggtccggaccagctccgcggtggcctccgggtcattccgggccgcggatatctgctccgcggcggccgccaggtccaggggcacgccgccgagcgcccggtgcacgtcggcccggatggcgtccaggcgatcgcggagctccacgtagtcggcgtagccatgttggaagaacggcacgtaccggcgcaggccgggcacgctcgtcatgtcgtccgccaggcgccccacggcctcgtggtagtcgataaacccgtcgcccgcctgggccatttccaggagcccctccgcgatgcgcagcagccgcgccaggggctcggcgtcgacccgaaacatgtcggcgtaggtttcggcggcggcgtggaacgccgcgctccagccgaggcggtggatggcggcgagcggggggagcatggggtggcgctggttctcgggggtgtaggggttaaacgcgaaggccgtatccagggcgagggtgaccgcctcggcgttggccgcgagcgcctgctcggcgcgcttgcggaagtcccgggggttgtagccgtgcgtgcccgccagcgcctgcaggcggcgcagctcgaccacgtcgaactcggcgcggttctcgacgcggtccagcgccgcctcgacgccggcggcccagcgctcgctgctgccccgggcgcgctgggccgccatcttcgccgtcaggtcggcgacggcggcctcaagttcgtcggcgcggcgtcgcgtggcgccgatgaccttgcccagctcctgcagggcgcgcccgctgggggaatggtccccggccgtcccttcggcgtgcagcaggcccccgaacccagcctcgtgccccgcgaggctttcccgagcagcggtcgtcgcgcgggccgcggcatcgatgagggcggcatggtccccctccggctgggcgcaggcccggcgcgcctggactaccaggtcggcggccgccgaccccagggtcgtgagctcgtcgatggccccccgcgcctccagggccagccgagtcgcctttacataccccgcggcgctatcggccagcaccgcgaggaaggacaggggcgaggccgggtcgcgggcggccgcgcccagggccgacaccgcgtccgccagggcgccatgcgcccgcacggccgcgtccaccgtcgccgcgggacttgccgtcgcgacggcggcgctcccggcgttgatggcgtttgacacggctttggcgattgtgggggcgtgatcggaaaagaactgcacgaggaccggcgtctcgggggcgtcggcgaacagggtcttcagcaccaccacgaaggcgggatgcaggccggccagagccgtcgcggtatccggggtcgggtgttccagggcctcccggtactgccccagcagcccccacaggtccgcccgcagcgccgccgtgacttccgggggggggccccggacggcatcggccaggtcggtccaccccgcgggcagggaggcccgcagggtcgccagcacggccggacacgcctttagccccacaaagtccgggaggggccgcaggaccccttggagtttgtgcaggaacttctcccgggcgtcgtgggccaccttggcgcgctcccgcgcgtcgttgagcatcgcctccagggcgtgggcgcgctcccgaagccgggagcgcgcctccggagcgagctccgccgtcatcttggccgcctccatggccctcgcctgccgcagcgcgtcttcggccatgcgcgtggcctcgggggacagcccgcccccgtcgacgtacggcgcggggccggtcgccgggacgaaggccgcgtcgctgtccagctgctgcgcgagcgccgcgtcgagggcgtcgaagcgctgcagttcggccagccccgagctgcgccgcgcctgctggtcgttgatgccgtggatgctgcgcgccagctcttccaggggcttgcgttcgatgagcccctgggtcgcggcgtcggtcaggaccgagagccaggccgccaggtcctcgggggcatctagggtctggccccgctggagcaggtcccgcagcaggatggcctgggggctggtggcgagggggggcgggggggggagcgcggcgcgctgagcgacgtcccgcgtgtgttggtcaaaggccggtagcgattccagcaactggaccatgggcacgaccgcggccgaggccacgtgaaaccgacagtcgtggctgtcgctggcctgcagggccttcgcgctgtatacggctccccggtggaagtactccttgaccgcgctctcgatcgcccggcgggcctggatccgcacgtcctccagccgcgcctggatggcctcggggcccagggcgggcgggcacggggccctgccgccggcgcccggggcggcgggcacgggcatcacggtcaggggcccggcgcgctgcgagaccgagtcgaccccgcgggcgagggcgtctaaggcctcgcgcatctcgcgggcctccgcctcgacccgcatctcttcgccccgggcaaactgggccagcgcctggatccgatggagaagcggctccgggtgcgtcggggtggcgggggcgaacagggtgttcgggtgggcgcgcgagcgctccaggagccactctccgaggcgtgcgtacagattggccggcggggcggcgcgcagctgcagatccaggtccgcgaggtccccgtaaaaggcgtccgtctcccgaataacgtccctggcgaccaggaccagcttagcgagggccaggcgcccgatctgcgaattttcgtccagcacgtgctggatgaggggccggtgggcggccacgtccgccaggctcatgcgcgtggacgccaggaagtccccgacggccgttttgcggggcagcatgcgcagggtgaagtccagcagggccgcggccgggccggccaccccggcctgcgtatgcgtgcgggccccgttctcgatcaaaaaggcgaggacgcgctcaaagaagaagatgacgcagagctccaacagccccgggtgcgccgggtacggcgaccgcagggcgttgatggtgagctgcgaacacgcggccacctcgcgggccagggcggcatcgcgcgccgcgagccggaccgccgtggcggccacattggggtggacctcgaacagctgcgccaggtcggcgccggggggctccggggggcggcgggcccccagcgtctcgagcacggacggcgacgacgggctcgcgggcccgtcgtcgccgccgccctgcccggactgcgggggggtatccggtgcgggagggaccgtggcggctatgggcgtcggggaggaggcggggacctcggcggcgacgggggccttcttcttgggcgcggacttcttcttggccttggcgggcggggccttgggggcgggcctctcgcccgaggtcagatcctccacgctggacggtggggtccaggtgggccggcggcgcttgggcaagccggtagaatagcgcgcccggtggcgacccaccggcactgcccccacctccaggacccgcaggtcctcggcttcttcggccgcgtccccggcgggtgtctgcgggggcggggcggcgtgcggtggacccgaggccgcggcgtccggggccgagggcttcgcgggcggggtcccctccagggctgctgcccacacatcatcgggggggcggtttgggtgccccgcctgcggtgtgtcgggtgggcccgaggccccccggggggcctcggggggccggtcggccccaggggtctggacgtgggtgggcgcggggagcgcggggacgaccgggcccgagccttctccgtcccccctggggaccacaccgacaaagagcgccccgagccccccgatctcgccccgcagggggtgggtgatggccacgcgccgctcgacgaacggttcgtcctgcaggtaagtctcgctggccccgtagaggtgcagggccgcggcggtcaggtccgccggcgccacggcccccgggccggagggcacaaaaaacaccatggcgcccgcccaccgcaccttggggcggtcgtgggcgtaatacgtcaggtacgggtacacgtcgcccgcccgcaccttggcgataaacgcgggcgttcccgcgggcaggccgtgcgggtcaaacagataggccgtgtcgccgtcccggtagagccccatgcccagggggccgatggtcaggagcgtgtaggacagcggccgcatggcccaggggccggcgaagaacgtgtgcgcggggcattgcgtctccagcagccccgccgtgggctccccgaagaagcccacctcgccgtacacccgcgaaaacacgcaacgcaggccgccgcgcgccgccgggtactccaggaagttggggagctcgataatggaacacatgcgcggcggcccggagcccgcggccgcgcgcgtccactcgcccccctccaccagacatccctcgatggcctccgcggacagcacgtcgcggggccccacgtcgaaaagaagactgagaaacgacagggacgagcgcatgcacgataccgacccccccggctccagatcggtcgcgaactggttccgaacaccggtgaccacgatatcgcgatccccctggcgcttcatcgtggggtgaggtagcgcggccggaatcatgtgtgccgcgcccgccacgagcggggcctgtttatgggccgggcgtcccgatgagtactgttgtttccgccgcccgaacccccccgcccatcaaccgcctgttcgtccccctaaccacacacccggtatcgcgtgtgtgtggtttcccgggaagacacatcccaccccatgaagttttgccctttttttccgtcccgcactacgccacctttccaccccccccccaaaaaaacaacaaccaactcccagatggatgggtgcgataataaagctttattattgtttaaccaaaggcgagtcctacgggtgtaccggtggtgtctcctgcggcgtcatctcgtcgtcctccacgggggtgttgggccaagggaccgtctcgcggcccgccgggcgcgtcgacggcgcgcgggcctgcgtgtcctgtgggccgggtgtcgtgggttcgggggtgctaccgccggcatcttgggcctccaggtccccgggggcccccgggccggcggaaggccgaaacgccgaggcgcgaaacacgccgtcggtgacctgcaggagctcgtttattaatagccagtccatgctcagcgtagcggccagcccctggggagacaggtccacggagtccggaaccaccgtcggctgacccaggggccccaggctgtagtccccccaggcccccaggtcatgacggttcgtgagcacgacgaggtctgcggccgggctggggggcgcgtcctcggtcgcgtgggccatcacctcctgaatggctgcggtgcgctgatcggccgagctggcgaagggcgccacgaccagcgcgcgctccgtctgcaggcccttccacgtgtcgtggagttcctgaacgaactcggccacccgctcggggcccgtggccgcgcgtgcggcctgatagccggccgagaggcgccgccagcgcgccaggaactgactcatgtaacagaacccggggacctggtcccccgacatcaactttgacgccctggcgtggatgcccgacacgatggccaggaacccgtggatttcccgccgcacgacggccagcacgttaccctcgtgcgagacctgggccgccagctcgtcgcataccccgaggtgcgccgtcgtctcggtgacgacggaccgcagccccgcgagggacgcgaccagcgcgcgcttggcgtcgtgatacatgccgcagtactggctcaccgcgtcgcccatggcctcggggcgccagggccccaggcgctcgtgggcgtctgcgaccacggcgtacaggcggtgcccgtcgctctcgaaccggcactcaaagaaggcggcgagcgtgcgcatgtgcagccgcagcagcacgatcgcgtcctccagctggcggaccagggggtcggcgcgctcggcgagctcctgcagcaccccccgggccgccagggcgtacatgctgatcagcagcaggctgctgcccacctcgggaggctgggggggaggcagctggaccgcgggccgcagctgctcgacggcccccctggcgatcacgtacagctcgcgcagcagctgctcgatgttgtcggccatctgcatcgtgggcccgacgccggcccgggtggccggttcgaggagggtgatcagcgcgcccaattttgtgcggtgcccctcgacggtggggagatagcccaggccgaagtcgcgcgcccaggccagcacccgcagggcaaactcgatggggcggggcaggtaggcagcgttgcacgtggccctcagcgcgtccccgaccaccagggccagcacgtaagggacgaaccccgggtcggcgaggacgttggggtggatgccctccagggccgggaagcggatcttggtggccgcggccaggtgaaccgagggggcgtggctaggcggcccgacggggagcagcgcggacagcggcgtggccggggtggtgggggtcaggtcccagtgggtctggccgtacacgtcgagccagatgagcgccgtctcgcgcaggaggctgggctggccggcgctgaagcggcgctcggccgtctcaaactcccccacgagcgtgcgccgcaggctcgccaggtgttccgtcggcacggccgggcccatgatgcgcgccagcgtctggctgaggacgccgcccgacaggccgaccgcctcacagagccgcccgtgcgtgtgctcgctggcgccctggatccgccggaacgttttcacgtagccggcgtagtgcccgtactcccgcgcgagcccgaacacgttcgcccccgcaagggcaatgcacccaaagagctgctggatctcgctgagcccgtggccggggggcgtccgcgcgggcacccccgccaccaaaaacccctccagggccgatatgtactgggtgcagtgcgcgggcgtgaaccccgcgtcggtaagcgtgttgatcaccacggagggcgagttgctgttctggaccaaagcccacgtctgctgcagcagcgcgaggagccgttgctgggccccggcggagggcggctcccctagctgcagcaggccggtgacggccggacggaagatggccagcgccgacgcactcagaaacggcacgtcggggtcgaagacggccgcgtccgtccgcacgcgcgccatcagcgtccccgggggcgcgcacgccgaccgcgggctgacgcggcttagggcggtcgacacgcgcacctcctcgcgactgcgaaccattttggtggcctcgaggggcgggatcatgatagccgggtcgatctcccgcaccgtgtgctgaaactgggccagcagcggcggcgggaccaccgcgccccgatcgggggtcgtcaggtactcgtccaccagcgccagcgtaaacagggcccgcgtgaggggggtcagggcggcgtcgtcgatgcgctgtaggtgcgccgagaacagcgtcacccaattgctgaccagggccaagaaccggagaccctcttgcacgatcggggacgggaagagcaggctgtacgccggggtggtcaggttggcgccgggttgccccaggggaaccggggacatcttaagcgacatctccccgagggcctccagggaggtccgcgggttcatggccaggcagctctgggtgacggtccgccagcggtcgatccactccacggcacactggcggacgcgcaccggccccagggccgccgtggtgcgcagcccggcggcctccagcgcgtgggtcgtgtcggagccggtgatcgccaggaccgtgtccttgatgacgtccatctcccggaaggccgcctcgggggtctcggggagcgccaccgccatgcggtgcaccagcagcccggggaggttctcggccaagagcgccgtctccggaagcccgtgggcccggtgcaaggcgcacagttgctccaggagcgggtgccagcacgcccgcgcctccgccgggccgaccgccgcgcccgacaacagaaacgccgccgtggcggcgcgcagtttggccgcggacagaaacgccggctcgtccgcgctgcccgccggctcgctcgagggggagggcggccggcggaggttggtcaggctccccaacaggacctgcaacggtccgtttgggggtggagcggacgggggggtcatgccggcgggcgccgggacctggagcgcgctgtccgacatggcgaccggcgtgcgcgctcggcgacgcggcgcggagaccgcgggcccaaacgggaatgactgccgccgccctatacggaggggctaagtatcgcccggggacccttcgaaaccccgggcgtgtcgcaagtacgccgcgaaggcgcggcgtgttatacggcgcgttatgtcccggcattccgttcgtgggttcgggcccgggtgctgtcgggtgggagtgtgtgtgggggggggcggcgcgacggcggcccggaccaagtgtatcgcggccgttccgtggggcggcccaacaggccctttaaacatttgcgtatgcaccggcccagccagtcggacaccggaacccaccagaggcggaagccgccttcgcccgtgagggtgcgtgtgttttctggtggcgtgtttttcctttccgccctcctccctccccacctccaccacccccccccacaactcgcccgttggcgatcggcgggaaaaccatgaaaaccaagccactcccgacagccccgatggcgtgggccgagagtgccgtggaaaccaccaccagcccgcgcgagctcgcgggccacgccccgctccggcgcgtcctgcgcccgcccatcgctcgccgcgacggcccggtgcttttgggggacagggcccccaggaggacggccagtacgatgtggctgctggggatcgaccccgcggagtcgtctccgggaacgcgcgctacccgagacgataccgagcaggccgtggacaagatcctcaggggagcccggcgcgcgggagggctgaccgtccccggcgccccccgctatcacctgacccgccaggtaaccctgacggatctctgccaaccaaacgcggagcgggccggggcgctccttttggccctgcggcaccccaccgacctcccccacctggcccgccatcgggctccgcccggccggcagaccgagcgactggccgaggcctggggccagctcctggaggcctccgccctggggtccgggcgggccgagagcggctgcgcgcgcgcgggccttgtgtcgtttaactttctggtggccgcgtgcgccgccgcctacgatgcgcgcgacgccgccgaggcggtccgggcccacatcacgaccaactacggcgggacgcgggccggggcgcggctggaccggttttccgaatgcctgcgcgccatggtccacacgcacgtgtttccccacgaggtcatgcggtttttcggggggctagtgtcgtgggtcacacaggacgagctggctagcgtcaccgccgtctgcagcggaccccaggaggccacacacaccggccacccgggcaggccccgttcggccgttaccatcccggcctgcgccttcgtggacctggacgccgagctgtgcctggggggccctggggcggcgttcctgtacttggtcttcacctaccgacagtgccgggaccaagagctctgttgcgtgtacgtggtcaagagccagctccccccgcgcggactggaggcggccctcgagcggctgttcgggcgcctccggataaccaacacgattcacggggccgaggacatgacgccccctcccccgaaccgaaacgttgactttccgctcgccgtcctggccgcgagctcgcaatccccgcggtgctcggcgagccaagtcacgaacccccagtttgtcgacaggctgtaccgctggcagccggatctgcgggggcgccctaccgcacgcacctgcacatacgccgccttcgcagagctgggtgtcatgccagacgacagcccccgctgtctgcaccgcaccgagcggtttggggcggtcggcgttccggttgtcatcctggagggcgtggtgtggcgccccggcgggtggcgggcctgcgcgtgatcgtctattgacgacggccgcccaacccgagcgaccttcccctcccacttccccccccctacacaccaactccgccctcgccgtcttggccgtgcgcggccccgtgcgtccgtctcaataaagccaggttaaatccgtgacgtggtgtgtttggcgtgtgtctctgaaatggcggaaaccgacatgcaaatgggattcatggacacgttacacccccctgactcaggagataggcatatcctccttagattgactcagcacacgatcgcaccccacccctgtgtgccggggataaaagccaacgcgggcggtctgggttaccacaacaggtgggtgcttcggggacttgacggtcgccactctcctgcgagccctcacgtcttcgcccaccgattcctgttgcgttcctgtcggccggtgctgtcctgtcgacagattgttggcgactgcccgggtgattcgtcggccggtgcgtcctttcggtcgtaccgcccaccccgcctcccacgggcccgccgctgtttccgttcatcgcgtccgagccaccgtcaccttggttccaatggccaaccgccctgccgcatccgccctcgccggagcgcggtctccgtccgaacgacaggaaccccgggagcccgaggtcgccccccctggcggcgaccacgtgttttgcaggaaagtcagcggcgtgatggtgctttccagcgatccccccggccccgcggcctaccgcattagcgacagcagctttgttcaatgcggctccaactgcagtatgataatcgacggagacgtggcgcgcggtcatttgcgtgacctcgagggcgctacgtccaccggcgccttcgtcgcgatctcaaacgtcgcagccggcggggatggccgaaccgccgtcgtggcgctcggcggaacctcgggcccgtccgcgactacatccgtggggacccagacgtccggggagttcctccacgggaacccaaggacccccgaaccccaaggaccccaggctgtccccccgccccctcctcccccctttccatggggccacgagtgctgcgcccgtcgcgatgccaggggcggcgccgagaaggacgtcggggccgcggagtcatggtcagacggcccgtcgtccgactccgaaacggaggactcggactcctcggacgaggatacgggttcggagacgctgtctcgatcctcttcgatctgggccgcaggggcgactgacgacgatgacagcgactccgactcgcggtcggacgactccgtgcagcccgacgttgtcgttcgtcgcagatggagcgacggccccgcccccgtggcctttcccaagccccggcgccccggcgactcccccggaaaccccggcctgggcgccggcaccgggccgggctccgcgacggacccgcgcgcgtcggccgactccgattccgcggcccacgccgccgcaccccaggcggacgtggcgccggttctggacagccagcccactgtgggaacggaccccggctacccagtccccctagaactcacgcccgagaacgcggaggcggtggcgcggtttctgggggacgccgtcgaccgcgagcccgcgctcatgctggagtacttctgtcggtgcgcccgcgaggagagcaagcgcgtgcccccacgaaccttcggcagcgccccccgcctcacggaggacgactttgggctcctgaactacgcgctcgctgagatgcgacgcctgtgcctggaccttcccccggtcccccccaacgcatacacgccctatcatctgagggagtatgcgacgcggctggttaacgggttcaaacccctggtgcggcggtccgcccgcctgtatcgcatcctgggggttctggtccacctgcgcatccgtacccgggaggcctcctttgaggaatggatgcgctccaaggaggtggacctggacttcgggctgacggaaaggcttcgcgaacacgaggcccagctaatgatcctggcccaggccctgaacccctacgactgtctgatccacagcaccccgaacacgctcgtcgagcgggggctgcagtcggcgctgaagtacgaagagttttacctcaagcgcttcggcgggcactacatggagtccgtcttccagatgtacacccgcatcgccgggtttctggcgtgccgggcgacccgcggcatgcgccacatcgccctggggcgacaggggtcgtggtgggaaatgttcaagttctttttccaccgcctctacgaccaccagatcgtgccgtccacccccgccatgctgaacctcggaacccgcaactactacacgtccagctgctacctggtaaacccccaggccaccactaaccaggccaccctccgggccatcaccggcaacgtgagcgccatcctcgcccgcaacgggggcatcgggctgtgcatgcaggcgttcaacgacgccagccccggcaccgccagcatcatgccggccctgaaggtcctcgactccctggtggcggcgcacaacaaacagagcacgcgccccaccggggcgtgcgtgtacctggaaccctggcacagcgacgttcgggccgtgctcagaatgaagggcgtcctcgccggcgaggaggcccagcgctgcgacaacatcttcagcgccctctggatgccggacctgttcttcaagcgcctgatccgccacctcgacggcgagaaaaacgtcacctggtccctgttcgaccgggacaccagcatgtcgctcgccgactttcacggcgaggagttcgagaagctgtacgagcacctcgaggccatggggttcggcgaaacgatccccatccaggacctggcgtacgccatcgtgcgcagcgcggccaccaccggaagccccttcatcatgtttaaggacgcggtaaaccgccactacatctacgacacgcaaggggcggccatcgccggctccaacctctgcaccgagatcgtccacccggcctccaagcgatccagtggggtctgcaacctgggaagcgtgaatctggcccgatgcgtctccaggcagacgtttgactttgggcggctccgcgacgccgtgcaggcgtgcgtgctgatggtgaacatcatgatcgacagcacgctacaacccacgccccagtgcacccgcggcaacgacaacctgcggtccatgggcattggcatgcagggcctgcacacggcgtgcctgaagatgggcctggatctggagtcggccgagttccgggacctgaacacacacatcgccgaggtgatgctgctcgcggccatgaagaccagtaacgcgctgtgcgttcgcggggcgcgtcccttcagccactttaagcgcagcatgtaccgggccggccgctttcactgggagcgcttttcgaacgccagcccgcggtacgagggcgagtgggagatgctacgccagagcatgatgaaacacggcctgcgcaacagccagttcatcgcgctcatgcccaccgccgcctcggcccagatctcggacgtcagcgagggctttgcccccctgttcaccaacctgttcagcaaggtgaccagggacggcgagacgctgcgccccaacacgctcttgctgaaggaactcgagcgcacgttcggcgggaagcggctcctggacgcgatggacgggctcgaggccaagcagtggtctgtggcccaggccctgccttgcctggaccccgcccaccccctccggcggttcaagacggccttcgactacgaccaggaactgctgatcgacctgtgtgcagaccgcgccccctatgttgatcacagccaatccatgactctgtatgtcacagagaaggcggacgggacgctccccgcctccaccctggtccgccttctcgtccacgcatataagcgcggcctgaagacggggatgtactactgcaaggttcgcaaggcgaccaacagcggggtgttcgccggcgacgacaacatcgtctgcacaagctgcgcgctgtaagcaacagcgctccgatcggggtcaggcgtcgctctcggtcccgcatatcgccatggatcccgccgtctcccccgcgagcaccgaccccctagatacccacgcgtcgggggccggggcggccccgattccggtgtgccccacccccgagcggtacttctacacctcccagtgccccgacatcaaccaccttcgctccctcagcatcctgaaccgctggctggagaccgagctcgtgttcgtgggggacgaggaggacgtctccaagctctccgagggcgagctcggcttctaccgctttctgtttgccttcctgtcggccgcggacgacctggtgacggaaaacctgggcggcctctccggcctcttcgaacagaaggacattcttcactactacgtggagcaggaatgcatcgaggtcgtccactcgcgcgtctacaacatcatccagctggtgctctttcacaacaacgaccaggcgcgccgcgcctatgtggcccgcaccatcaaccacccggccattcgcgtcaaggtggactggctggaggcgcgggtgcgggaatgcgactcgatcccggagaagttcatcctcatgatcctcatcgagggcgtcttttttgccgcctcgttcgccgccatcgcgtacctgcgcaccaacaacctcctgcgggtcacctgccagtcgaacgacctcatcagccgcgacgaggccgtgcatacgacagcctcgtgctacatctacaacaactacctcgggggccacgccaagcccgaggcggcgcgcgtgtaccggctgtttcgggaggcggtggatatcgagatcgggttcatccgatcccaggccccgacggacagctctatcctgagtccgggggccctggcggccatcgagaactacgtgcgattcagcgcggatcgcctgctgggcctgatccatatgcagcccctgtattccgcccccgcccccgacgccagctttcccctcagcctcatgtccaccgacaaacacaccaacttcttcgagtgccgcagcacctcgtacgccggggccgtcgtcaacgatctgtgagggtctgggcgcccttgtagcgatgtctaaccgaaataaaggggtcgaaacggactgttgggtctccggtgtgattattacgcaggggaggggggtggcggctggggaaagggaaggaacgcccgaaaccagagaaaaggaccaaaagggaaacgcgtccaaccgataaatcaagcgccgaccagaaccccgagatgcataataacgattttattactcttattattaacaggtcgggcatcgggaggggatgggggcgcgcgtttcctccgttccggctactcgtcccagaatttagccaggacgtccttgtaaaacgcgggcgggggcgcgtgggcccacagctgcgccagaaaccggtcggcgatgtccggggcggtgatatgccgagtcacgatggagcgcgctaaatcttcgtcgcggaggtcctgatagatgggcagtctttttagaagagtccagggtccccgctccttggggctgataagcgatatgacgtacttgacgtatctgtgctccaccagctcggcgatggtcatcggatcgggcagccagtccagggcctccggggcgtcgtggatgacgtggcggcgacgtccggcgacatagccgcggtgttccgcgacccgctgcgcgttggggacctgcacgagctcgggcggggtgagtatctccgaggaggacgaccgggcgccgtcgcgcggcccaccggcgacgtccgggggctggaggggggggtcttcttcgtagtcgtcctcgcccgcgatctgttgggccagaatttcggtccacgagatgcgcgtctcgaggccgaccggggccgcggtcagcgtaggcatgctctccagggagcgcgagttggcgcgctcccgccgggccgcccggcgggcctgggatcggctcggggcggtccagtgacactcgcgcagcacgtcctcgacggacgcgtaggtgttattggggtgcaggtctgtgtggcagcggacgaacagcgccaggaactgcgggtaactcatcttgaagtactgcagcaggtcgcggcagtgaatcgtcggaatgtagccggtgctgatgtccaacacgatatcgcagcccatcagcaggagatcggtatccgtggtatgcacgtacgcgaccgtgttggtatgatagaggttcgcgcaggcgtcgtcggcctccagctgacccgagttgatgtaggcgtaccccagcgcccgcagaacgcggatacagaacaggtgagccaggcgcagggccggcttcgagggcgcgcccgagggggccgccgggcctgggccggcggcccgcgttccccggtcccccggggcgaaggcgtgcccgcggcggcgcatgttggaaaaggcgaaactgggcctggagtcggtgatgggggaaggcggcggcgaggcgtctacgtcactggcctcctcgtccgtgcggcactgggccgtcgtgcgggccaggatcgccttggccccgaacacaaccggctcggtacactcgaccccgcgatcggtcacgaagatggggaacagggacttttgggtaaacacccgtaacatactacagagacagtgtagcgtgattgcctcgcggtcgtaacttgggtagcggcgctgatatttaaccaccagggtatacatgacattccacaggtccacggcgatgggggtaaagtagccctccggggcccggaggccccggcgcttcaccagatggtgagtctgggcaaacttcatcatgccaaacagacccattccggcacgattgtaggtgcggataggtctctctacagagctgtataggtgtgacggtccgggacacccaagcccgccgcccctgtgtacagtggctgcggcgacgaccccgctccaacaagacgctatcccgggaaaggcacgctctttataattcttttttatttcccatctacgtgcggattggtgcaaccgccggcgcgcgccggtgcaggccgaccatctctctcttccccccctccccctcccccgagccctcaaagagggtgtggcctaactagcggaaggcgtatttaaccagactagggcggcgggtccgccgtagtccttggctcgggtagccactgctctgtggctcgggtcccccggcccccctaacccccatccggtccgcgtcatccgccccctccgcctgcgacacaaacggccgcgcctccgggcccggtgacacgacgcgcctcgtctctgcggattgtcccgggagcgtcgcggcatggctcatcttcccggcggtgcggccgccgcccccctttcggaggacgcgatcccgtcgccgcgcgagcggacggaagactggccgccctgccagatagtgctgcagggcgccgagctgaacgggatcctgcaggcctttgcgccgcttcgcacgagccttttggactcgctcctggtcgtgggcgaccgaggcatccttgtacataacgcgattttcggcgagcaggtgtttctgcccctcgaccattcgcagttcagtcgctatcgatggggcggacccaccgcggcgttcctgtctctcgtggaccagaagcgatccctgctgagcgtgtttcgcgccaaccagtaccctgacctgcggcgggtggagctgacggtcacgggccaggccccgtttcgcacgctggtgcagcgcatatggacgaccgcgtccgacggagaggccgtggagcttgccagcgagacgctcatgaaacgcgagttgacgagcttcgcggtactactcccccagggcgaccccgacgtccagctgcgcctcacgaagccccagctcacgaaggtggtgaacgccgtcggggacgagaccgccaaacccaccacgttcgagctcggccccaacggcaagttttccgtgtttaacgcgcgcacctgcgtcacctttgccgcccgcgaggagggcgcgtcgtccagcaccagcgcccaggtccagattctgaccagcgcgctgaagaaggcgggccaagcggccgccaacgccaagacggtctacggggaaaacacacaccgcacattctcggtggtcgtcgacgactgcagcatgcgggcggtcctccggcggctccaggtcggcggggggaccctcaagttcttcctcacggccgacgtccccagcgtgtgtgtcaccgccaccggccccaacgcggtgtcggcggtgtttcttttaaaaccccagcgggtctgcctgaactggctcggccggagcccgggttcctcgaccgggagcttggcgtcccaggactctcgggccggcccgaccgacagccaggactcctcctccgagccggacgcgggcgaccgcggcgccccagaagaagaaggcctcgagggccaggcccgggtaccgcccgcgttcccggaaccgccgggaaccaagcggaggcaccccggggccgaagttgtccccgcggacgacgccaccaagcgcccgaagacgggcgtgcccgccgcccccacgcgagccgagtcgccccccctctccgcgagatacggacccgaggcggcggagggtggtggggacggcggccgctacgcgtgctactttcgcgacctccagaccggcgacgcgagccccagccccctctccgccttccggggtccccaaagacccccatacggctttgggttgccctgacggcaacgggtggtggccgaacgcctcaccgcgcccgggcacgcggggtgcgttgtgttaaaaaaataaataaatggggtagtgtgtcccccccccctccaaccaatatggctgtcgtgtgtggttccgggttgcgcctccgtcctttccaccccccttccccctccttttttgttttgcgtgcgcttataagagcgggcccggggcccttcgcagcttcaccgagagcgccgtcgggccccgggtgcgggatgtgtcgcggggacagccccggggtcgcgggcgggagcggcgaacactgcctcggaggggatgatggggacgacgggcgcccccgcctcgcctgcgtgggtgccatcgctcgggggttcgcgcatctctggctccaggccgccacgctgggcttcgtggggtctgtcgttctgtcgcgcggcccgtatgcggacgccatgtcgggggcgttcgtgatcgggagcaccggcctggggttcctccgcgccccccccgcgttcgcccggccgccgacgcgtgtgtgcgcgtggctgaggctggtcggcgggggagcggccgtggccctgtggagcctcggggaggccggcgcgcctccgggggttccgggcccggcgacccagtgcctggcgctcggggccgcctacgcggcgctgctggtgctggccgacgacgtccatccccttttcctcctcgccccgcggcccctgtttgtcggcaccctgggggttgtcgtcggcgggctgacgataggcggcagtgcgcgctactggtggatcgacccccgcgccgccgcggccctgacggcggcggtggtggcgggcctcgggacaaccgccgccggggacagcttttccaaggcctgtccccgccaccgccgcttttgcgtcgtctccgcggtcgagtctcccccgccccgatacgccccggaggacgccgagcggccaacagaccacggacccctgttaccgtcgacgcaccaccagcgatctccgcgggtctgcggcgacggggccgcacggcccgaaaacatctgggttcccgtggtgacctttgcgggcgcgctcgcgctggccgcctgcgccgcgcgagggtctgacgcggctccgtcaggcccggtcctgccgctgtggccccaggtgtttgtcgggggccacgcggcggcgggcctgacggagctgtgtcagaccctcgcgccccgggacctcacggacccgctgctgtttgcgtacgtcggattccaggtcgtgaaccacgggctgatgtttgtggtccccgacatcgccgtatacgcgatgctggggggcgccgtgtggatctcgctgacgcaggtgcttgggctccggcgccgccttcacaaggacccagacgccgggccctgggcggccgcgaccctgcggggcctctttttctccgtctacgcattggggtttgcggcgggggtgctggtgcggccgcggatggcggcgagccggcggtcggggtgatcgccatttcaaataaaaggcacgagttccccgaataccaccggcgtgtgatgatttcgccctaccgctccgatccccggggggaggggggaaggaaatgggggcgggggtgccgtggacgggtataaaggccaggggggcaggcgggcccatcactgttagggtgttaggttgggaggtggcacaaaaagcgacactcccgtgttgtagttgtccgcgggaggcggtggtttccggcaaccctcctcgctgcgccgggcgcgcccaccggtccttcgcgggggccggggctcttctggtcatggcccttggacgggtgggcctagccgtgggcctgtggggcctgctgtgggtgggtgtggtcgtggtgctggccaatgcctcccccggacgcacgataacggtgggcccgcgggggaacgcgagcaatgccgccccctccgcgtccccgcggaacgcatccgccccccgaaccacacccacgcccccccaaccccgcaaggcgacgaaaagtaaggcctccaccgccaaaccggccccgccccccaagaccgggcccccgaagacatcctcggagcccgtgcgatgcaaccgccacgacccgctggcccggtacggctcgcgggtgcaaatccgatgccggtttcccaactccacccgcacggagttccgcctccagatctggcgttatgccacggcgacggacgccgagatcggaacggcgcctagcttagaggaggtgatggtaaacgtgtcggccccgcccgggggccaactggtgtatgacagcgcccccaaccgaacggacccgcacgtgatctgggcggagggcgccggcccgggcgccagcccgcggctgtactcggtcgtcgggccgctgggtcggcagcggctcatcatcgaagagctgaccctggagacccagggcatgtactactgggtgtggggccggacggaccgcccgtccgcgtacgggacctgggtgcgcgttcgcgtgttccgccctccgtcgctgaccatccacccccacgcggtgctggagggccagccgtttaaggcgacgtgcacggccgccacctactacccgggcaaccgcgcggagttcgtctggttcgaggacggtcgccgggtgttcgatccggcccagatacacacgcagacgcaggagaaccccgacggcttttccaccgtctccaccgtgacctccgcggccgtcggcggccagggccccccgcgcaccttcacctgccagctgacgtggcaccgcgactccgtgtcgttctctcggcgcaacgccagcggcacggcatcggtgctgccgcggccaaccatcaccatggagtttacgggcgaccatgcggtctgcacggccggctgtgtgcccgagggggtgacgtttgcctggttcctgggggacgactcctcgccggcggagaaggtggccgtcgcgtcccagacatcgtgcgggcgccccggcaccgccacgatccgctccaccctgccggtctcgtacgagcagaccgagtacatctgccggctggcgggatacccggacggaattccggtcctagagcaccacggcagccaccagcccccgccgcgggaccccaccgagcggcaggtgatccgggcggtggagggggcggggatcggagtggctgtccttgtcgcggtggttctggccgggaccgcggtagtgtacctcacccacgcctcctcggtgcgctatcgtcggctgcggtaactccggggccgggcccggccgccggttgtcttcttttccaccccttccgtcccccgtacccaccacaccccaccccacccccccgccgtcccccgggcgttataagccgccgcactcgcttttcccaccggaaaatcctcggcccgatccgaacggcgcacgccgcgtgggctccaaacgcctccggaagagagcgccccgccccgatattcaagcccgcggtggtgctatggctttccgtgcttcgggacccgcctaccagcccctcgcccccgcggcctccccggcgcgggctcgtgttccggccgtggcctggatcggcgtcggagcgatcgtcggggcctttgcgctcgtcgccgcgttggttctcgtaccccctcggtcctcgtggggactctcgccgtgcgacagcggctggcaggaattcaacgcgggatgcgtcgcgtgggaccccacccccgtcgagcacgagcaggcggtcggcggctgcagcgcgccggccacccttatcccccgtgcggccgccaagcacctggccgctctgacacgcgtccaggcggagagatcgtcgggttactggtgggtgaacggagacggcatccggacctgtctgagactcgtcgacagcgtcagtggcatcgacgagttttgcgaggagctcgcgatccgcatatgctactacccacgaagccccggcgggtttgtccgcttcgtaacttcgatacgtaacgccctggggttgccgtgaggcgcgcgtccgacggtcccgcttctcgcctctcttcttcccccaccccacccaccgaccaacgacggcgtttggccaataccctccttttttctttttctcttccccccccccccaaaaaaaacaataaacagctaattgcgtacgacaaaccatgcggaactcgctgttttttttctctgtttgttactttttattgaaacagacatacggggaaaggggccggaaaccgagacggtggggccggcggtcgcatttttttaatggctctggtgtcggccgcgtttgagcttcgtcaacagggcgctgagggcggcgacgttcgtcgggccgtcgttggccagcgcgttggtccgggggcgggcgggcatgggcgacaggcttagtcccgggtccggggcgcgtgtggcccccggaggggagaagagggcagacccgccccagtcgtacaggggattttccgcctcgatgtacggggagtccggggcgtctcccggcagggcggccccgccggcaagacgccggcgagggcagatgttttcgtatacccgaacccaggggatctcctcgtagacgcgccccccatcctcgcccaccgactcgtaaatggaatctgcgtcctcggagggggcgcggggggcgtggctttcggccggccaggcggcggcggcggtggtgtcggcggcgggggtggcgccaagcccgacgcccgcgggcatggcggcgtcatcgtcgggcagcagatacgtgttttccatctggtccggttcggcctccgcgtccggcccccaggtccgcaccgcgtcgtagaccccggcggcctcgcgctgagccgcgagcgggcgcgccgcggctgccggccgctgctcggggggcgcggggttgcggggcgggaggcgcgggggcgccccggccatatgcgtgtaatacgtggccggccggccggcgcagggctcgggaccccggtcggccgcgtcgacgtgcgggggctcggggaggtcctcgcggtggcgcctgaacctccgaggggccgcgggggtcgagtgggggcgagcccgggggagcggcgggggtgcgttgtcgcgccgggtccgttgtatcttgtcccggcagctcccgccgaccgcgccgcggccccccggtgggccggacgccgcgaggcgcaggatggactcgtagtggggcgacggggttccgctccgaagcaggtccggggccagggcggccccgaaccaggacttgatgctgagttccatccgggcccagctcggggcggtcatcgtggggaacaggggggcggcggtcctgcagaagcgctcctggctgtccaccgccgcccgtaggtactcgttgttcaggctgtcggaggcccagacgacatacccggtaagcgtcgcgttaattatatactgggcgtggtggtggactatggatagaacctcgacggtcgagacgatggcgtccacgatcccgtacgtgccgccgctgcgcttgccggtctcccacaggtgggccaggcgcgtcaggtggcccaggacgtcgctgaccgccgcccgcagggccatgcactgcatcgagcccgtggtgccgctgggcccgcggtccaggtggcgcgcaaacgtctccgcgggcgcctccagactcccgctgagcgccacgaaccggcgatcggcggggcccaggcggcgacacacgtacttgtccgccgtccacagcatccacgaggcccaatggtacaacacggagacgtaggccaggagctcgctcagccgcagtgcggtgtccgtgctcggccggctcgggtctgcggggcgcataaagaacatgtactgctggagcctgtgggccgcgtcgcgcaaccccgccaccgcggcggcgtacttggccgcggcggccccgctcttgaacggggcgcgcaccagcagcttcgggagcagggtgggccgcagcagcacgtgcaggctggggtcgcagtcgcccgccgggtcgtcggggatgtccaggccgctgggcacgaccgtctggaggtacttccagtactgcgctaggatggcgcggctcagctggccgcccgacagctccacctcgccgagcgcctgcttggcggccgacgcgtagtgccggatgtagtcgtagtgcgggtcgctggcgagcccgtctacgatcaggctctcggggacggtgttatggtgccgcgccgccagccggacgctgcgatcggcgccggtcagaaacgccggctgcaggtcgtcggcgcgctgccgcaggacgcccacggccgcgctgaggagcccctccggggtggggagcagacacccggcgaagatgcgccgctcggggacgcccgcgttggcgccgcggatgaggttggccggcgtcaggcaccgcgccagccgcagggagctcgcgccgcgcgcccggcgttgcatggcggagaccgttcggtcgggggccccgccggtcggaggtatgccgcgtcccgggatatagggttgctttttatggggaggcgcctatgggcgtggcgggccgcccagcccggtcgcgcgcctcccggacacgtgcgcccggagggcggcggtctcctcgtcgcccatgagcagtttccgaaactgcgccatgatgtccacgacgcggacccgcggccccagcacggactcgctattcaggggggcgggggggaaggccgccaggtcttcgagcaggaaggcggggtctgccgtcccgctcacgggcgcccggggcgccgaggacgcggggcgaaggtccacgtgttccgcggcggcgcgcacgtccgcccaaaatttggcgggggtggtccgcgcgtacaggggctgggtcgcgcggaggacgcacgcgtagcgcaggggggtgtacgtgcccacctcgggggccgtcgacccgccgtcaaacgcggccagggccacgcacgcgaccaccgtgtcggccaggcccagcagccgctgcaggatgagccccgtcgccagcacggcgcgcgcggccgccgcgtcgtccctgcgccggcgcgcgtccccgcaggccagggcgtatttcagggtaacggtcgccagggccgtgtgcagcgcgtacacggccgcgcccagcacggcgttcagcccgctggtggcgagcaggcggcgcgccgcggtgtcgcccagcgcctcgtgctcggccgccacgaccccggggctgcccaggggcagggcgcgaaacagcgcctcctgctccacgtccgcaaacgcggggtgggcggagtgcgggtgcaggcgcgcccccacgaccaccgagagccactggaccgtctgctccgccaggaccgccagcacgtccaggacgcgccccgcaaacgcggcctcccgcgggagcacgcatttgacggcgccggggttgaagcgggcgagcagagccccggtggcgatgtacgtcatgcgccccgcgtagcgggcggccacgcgacagtcgcgccccaggagcgcgcgcaccccgggccagtacagcagggaccccagcgaactgcgaaagaccgcggcgtcggggccggggtgggggggcgcggcccctcccgcgctgagcagcggcacggcggcggcccccacgggccgcaacgccgtgaggctcgcgaactgccgtcggagctcggccgccctgtcgtcgagctccgagccgcgcccctccgtgtgcaggcgcgtcccgcagacccacccgttgatcgccacccgcacgatggcgtccaccagaaagcccatcgcgcgggaggggctggtttttgcccgccgatccgtcaggtcgaggatcgcgtcgcccgtgacgtaccaggccagcgcctcgccctgctgcagcgtctggcggaaaaacacctttgggtcggccggggaggcaaagtgcatgacccccacgcgcgacagcccgaacgcgctatccggacacgggtagaacccggccggatgtcccagggccagggccgagcgcacggactcgtcccacgcggcgactcggggggtcaggcggtccagggggaatgccgcctgcagctccgggcccgacacgcggcccgcgagaatctcgaccgtcgcggaaggccgcgccccggcgccgtcatcgtgcgcgacggcggcggggtagtcgtcctcctcgtagttgagctcgtccaggaacagcggcgagggcaccacccgcgaaccgcccacccgccccaaaacgtcgcgtgggtccatcgggcccaggtagcctccccgcggggcccgcgtgatggcgctgtcccggcgtccgcgaacggactggctcctggccgtaacggacctggggcgcggaaaggacgcccggcgggggggcgccgccgcccgggcctcggacgcgcgtcgggacccggggtgaccgcgggcctcccggcgacggcgcgggggcggctcttcgctcgccatctcccccgcggcctcgacctcgctgtcgtcgtccacgttaaacaccgcccgcaggtaccccattaacccgactccaccgccctcgggctcgtcctccacgggcgagtcggcgcgatgcgcggacggggcatgggaccgggtggaggcgcgcctccggcgtacggcatgcccgcgcacggacatggtggccggaggcccgattttttacacacgccctccccgcagacggacgaggaaaggggtggtgcgaggggggaggcccaaacggggaggtggggggtagggggcggtcccagggagcggggggtaggaaccggcacgacgggaacagagaaaacgcgaccgctccaacaagggtgggggggtgggcctcgtccccacgcagacccgcgggcaaatgcgagaacgggacccgcgcgcctgcctttatacgcggaccccagcaccacgagccgttctgtgacgcgaatctacacgaccgcgggctcgtaggcgcgactaacgcccaacccaacggcacacaccccccaccccgcgcgtaaccccatttctttcatggtcccgtaataaacagccaacgcacgccgcgtatgatgagttgcttgccaatgtttattgctgtggttgcgaaccctctatcgcgatacagacggaggtgaggcggggcggtggtgggggggggcgcgccgcccggtcgcacatcctaccccccaaagtcgtcaatgcccatggcatcggtaaacatctgttcaaactcaaaatcgtccacgtccaaagccccatacgagacggggtcgtgggtcattcccggggagggggactccacgtcccccagcatctccaagtcgaagtcgtccagggcgtcggcgggcgtcatatccacctcctcgccgtccaggcggagttcgtctcccaggctgacgtcggtaatgggggcggtggtggacagtctgcgggggcgttgtcccgcggagagaaacgacatgcgcggcgccaccagcccggcctccgcgggagcgtcatcgtcgtccgggaggtcgagcaggccctcgattgtcgatccgtaattgtttctggtccgcccgcggctatacgcgtgctcccgcatgacggactcgccctccgaggtcgcgacgctggagtacgagtccaacttggcccggatcagcagcataaagtacccagaggagcgggcctggttgccctgcaggacgggcggggtcgtgaggggcgccccgggttcctccgccgccgcacttcgcaccagcgggaggttcaggtgctcgcgaatgtggtttagctcccgcagtcgccgggcctccacgggaactccccgcacggtgagcgatccgttgataaacatcaggggctgaaacagacacgccaactggcgccagctctccaggtcgcagcagaggccgtcgaacagatcgggccgcatcatctgctcggcgtacgcggcccataggatctcgcggctcagaaagaggtatagatgcagaaacaggacgcgcgccaggcgcgcggtctcgcggtagtacctgtccgcgatcgtggtgcgcagcatctcccgcaggtcgcggttgcggccccgcatgtgtgcctggcggtgtagctgccgaacgctggcgcgcaggtaccggtacagggccgagcaaaaatttgccaacacggtccggtagctctcctcccgcgcccgcagctcaccgcggaaaaactgcgccatggcctcgtagtacgaaggcagctcgtcgcgggtggcgggcagggtggggaacgccacgtcgccgtgggcgcgaatgtcgatcggggagcgctcggggacgtgcgcatccccccagtcgatcacgtcgctgggcagcgtcgacagaaacttgcactcccggtacatgtcggcgttggtcgggaacccagagaacaggtcctcgttccaggtatctagcatggtacacagcgcgggacccgcgctgaagcccagatcgtcgaggagacggttaaacagggccgcgggggggacgggcatgggcggcgagggcatcagctgggcctgactcagccgaccggtggcgtacagcggaggggcggctggggtgttcttgggacccccggctggcctggggggcggtggcgaaaccccgtccgcgtccgcaaacagatcgtcgaccaacaggtccatgggggcggttgggtccgggaataacgatctcgagaggcgaatgagacgtgcccgagcgcccggcggcggagagggggggagggatccgggacccgcgacagaaaaaggccggggccctcgcgaagggaatcgccgggggtgccgtgcgtccccgaggactgacatctcgcgtccaccaccccgcatttaagtatcaccccagtgccgccccaaacctcgtgacttccccaccgctccgggcggcccgtcccccgcgctcggaagggaggcgtgtccttcctcccgcccctcccgcccctcccgcccctcccgcccctcccgcccctcccgcccctcccgcccctcccgcccctcccgcccctcccgcccctcccgcccctcccgcccctcccgcccctcgccacaaacgcgtgctgacagcgaagtggttaaatcgaccgtgatgctttattgtctgtcgtctgaacgcggtcggggtcgctactcgagggggcggcggggacgggaagccgagcgggcgggggcccgtgcggtcgcggcggcacgccccgcggggcggccccgggcggccgcggtcgcgtcgacgtcctgcgccgcgtcgggattcaccaactcgttcgcgcgctgcaggaggttcttgccctcgcagaccgtcacgcgaatggtggtgaggtcgaggagctcgttgaggtcttcgtcggtgtgcggccgcgacatgtcccacagctgtaccgccgccagccgggcgtgcgtggccgccaggcgcccgaccgcggcgcagaagacgcgcttgttgaacccggccacccggggggtccacggcgccgtggggctcggtggggcggtgctgaagtgcagcttcttggccagtccctgggcgggtgtcttggttcttcccgaggccgtgggagcgggggcgtctaggagcacggcggagtcggcctgggcgggtcgcctgccgcgggcggggtcggtcgccggggtcgcggaggccttaggcgccccgcgcgtcattttgggggtccgcgcgggaggggcgtgcgagcgcccgccggcgcccacggggcccccggggggtggaggagcgcgcgcggggccggggccgtgagagcccgcgacggacgccgaacgacgcggtcgcgcggtatcccgggactcgtcgtcgtccgaagacgagtcccggtagagggcatacccagcctcgtcataatggagaaagcgaacctcgcccctcgggcgcgcgcgcatcgggccagcgccgcggcggaagtcgtcgcgcggactctctgggtccgccggggagaccgggccatagtacagctcctcgtgggtcccgcgcggcgcttcccgcggacacgacttgacggagcggcgagaggtcatggtctatcggagacaccggggacgcccgtgcggatcacagggaaggcgtcggcgaaggaggcagagagcgtcggaaggcggcgagggagggaaagagggagaccggcggggtacgggagagcagcgagggcctgcgtaacccacgggggccgcgggagtggctccctgcgggttgcgggggagagtttataggaagtggatataaccgcaggcgacgggactaaccaatccccgggggggcaacggacagacacgccccgaacaggcccgacttccgcgaggaagcaaaggccgggggccgcccaacgacacgcccaccccttcccaacagggcgggctcaggctgacccggcggccagtgcccgctgacatatctgatacacgtgcgcgatcatacatacgcccatcgaggtcatgcctagataaaagggcaccaggacccccgggacggacaccacaccggcgctgtcgccccggcattgcgcgtccccgataacgccgcgtgcgcctgccgcgttcggcggctccccgggcacgcccgcgacgagcgcgacgaacaacagcaccacccagcggcccagtcttgcgggtttccccgtcatcgcggcgatgagtcagtgggggcccagggcgatccttgtccagacggacagcaccaaccggaatgccgatggggactggcaagcggccgtagctattcgcgggggcggagtcgttcaactgaacatggtcaacaaacgcgccgtggattttaccccggcagaatgcggggactccgaatgggccgtgggccgcgtctctctgggcctgcgaatggcaatgccgcgggacttctgcgcgattattcacgcccccgcggtatccggccccgggccccacgtgatgctcggtctcgtcgactcgggctaccgcggaaccgtcctggccgtggtcgtagccccgaacgggacgcgcgggtttgcccccggggccctccgggtcgacgtgacgtttctggacatccgggccacccccccgaccctcaccgagccgagctccctgcaccggtttccgcagttggcgccgtccccgctggcagggttacgagaagatccttggttggacggggcgctcgcgaccgccgggggggcggtggccctgccggccagacggcgcgggggatcgctggtctacgcgggcgagctaacgcaggtgaccaccgagcacggcgactgcgtgcacgaggcgcccgcctttctgccaaagcgcgaggaggacgcaggctttgacattctcatccaccgagccgtgaccgtcccggccaacggcgccacggtcatacagccgtccctccgcgtattgcgcgcggccgacggaccagaggcctgctatgtgctggggcggtcgtcgctcaatgccaggggcctcctggtcatgcctacgcgctggccctccgggcacgcctgtgcgtttgttgtatgtaacctgaccggagtcccggtgaccctacaagccgggtccaaggtcgcccagctgctcgtcgcggggacccacgccctcccctggatcccccccgacaacatccacgaggacggcgcattccgggcctaccccagaggggttccggacgcgaccgccaccccccgagacccgccgattttggtgtttacgaacgagtttgacgcggacgcccccccaagcaagcggggggccggggggtttggctccactggcatctagaccgcgcctcgcgtcgggccagatggggccccggtcaataaagagctctgtttcgcatatgccctggtgttggcggttttttttgttgtctgtctgcccggcgctcggttgtccgttctgtcgtcgctatcacatacgcacaaacacacgggtagagtggaaccgaaaccggtcgacgtttattcaccacacagaaacacaagctaagcgagaaggaggggggcctcggtcgacgaggcctggcgtttgggggcggacgtgcgatgacgtgggtccggtgtagggtccgcggggggcacgggcccggggcgaacgggggatctgtcgccggcgtgggtgactgggaccgacgcaacctccggggcttgtgccctcgtaggcccggggggggcctcggtcgctccaagccccgcggtgcgggtccctccggccagagccgaggtggagagaccaagggcccgctccgcgatcgccacgtcctccatgaccacgtcgctctcggccatgctccgaatggcctgggagacgagcacgtccgccgacttgtccgcggcccccaccgacatgtacatctgcaggatggtggccatgcacgtgtccgccaggcggcgcatcttgtcccgatgcgccgcaacggccccgtcgatggtggagccctcgagtcccgggtggtggcgcgccagcctctcgaggttgaccatgcaggcgtggtatgtgcgggccagggcgcgcgccttcacgaggcgccgggtgtcgtccagcgactctagggcgtcgtcgagcgtgatgggggcgggcaaaagcgcattgaccaccgccagggcctcctgcagccgcggctccgcctccgagggcggagccgcggcccgaatcatctcatattgttgttcctcggggcgcgttccccaaccgcacagcaccccgagcagggacgccatcccggaacacgcgcgcggctctgcgccggctttcccccaccccaccccctccgggttcgcaggggcgatggggacggaagactgcgatcacgaagggcggtcggttgcggctcccgtggaggttacggcgctgtatgcgaccgacgggtgcgttatcacctcctcgctcgccctcctcacaaactgcctgctgggggccgagccgttgtatatattcagctacgacgcgtaccggtccgatgcgcccaatggccccacgggcgcgcccaccgaacaggagaggttcgaggggagccgggcgctctaccgggatgcgggggggctaaatggcgattcatttcgggtgaccttttgtttattggggacggaagtgggcgtgacccaccacccgaaagggcgcacccggcccatgtttgtgtgccgcttcgagcgagcggacgacgtcgccgtgctccaagacgccctgggccgcgggaccccattgctcccggcccacgtcacagcaactctggacttggaggcgacgtttgcgctccacgctaacatcatcatggctctcaccgtggccatcgtccacaacgcccccgcccgcatcggcagcggcagcaccgcccccctgtatgagcccggcgaatcgatgcgctcggtcgtcgggcgcatgtccctggggcagcgcggcctcaccacgctgttcgtgcaccacgaggcgcgcgtgctggcggcgtaccgccgggcgtattatgggagcgcccaaagccccttttggtttctgagcaaattcggcccggacgaaaagagcctggtgctggccgctaggtactacctactccaggctccgcgcttggggggcgccggagccacgtacgatctgcaggccgtgaaagacatctgcgcgacctacgcaatcccccacgacccacgccccgacaccctcagtgccgcgtccttgacctcgttcgccgccatcactcggttctgttgcacgagccagtactcccgcggggccgcggccgctgggtttccgctgtatgtggagcgccgcatcgccgccgacgtacgcgagaccggcgcgctggagaagttcatcgcccacgatcgcagctgcctgcgcgtgtccgaccgggaattcattacgtacatctacctggcccactttgagtgcttcagccccccgcgcctggccacgcatctccgggccgtgaccacccacgaccccagccccgcggccagcacggagcagccctcgcccctgggtcgggaggcggtggaacagttcttccggcacgtgcgcgcccagctgaacatccgcgagtacgtaaagcaaaacgtcacccccagggaaaccgccctggcgggagacgcggccgccgcctacctgcgcgcgcgcacgtatgccccggcggccctcacgcccgcccccgcgtactgcggggtcgcagactcgtccaccaaaatgatgggacgtctggcggaagcagaaaggctcctagtcccccacggctggcccgcgttcgcaccaacaacccccggggacgacgcggggggcggcactgccgccccccagacctgcggaatcgtcaagcgcctcctcaagctggccgccacggagcagcagggcacgacgcccccggcgatcgcggctctcatgcaggacgcgtcggtccaaacccccctgcccgtgtacaggattaccatgtccccgaccggccaggcgtttgccgcggcggcgcgggacgactgggcccgcgtgacgcgggacgcgcgcccgccggaagcgaccgtggtcgcggacgcggcggcggcgcccgagcccggcgcgctcggccggcggctcacgcgccgcatttgcgcccggggccccgcgctccccccgggcggcctggccgtcgggggccagatgtacgtgaaccgcaacgagatcttcaacgccgcgctggccgttacgaacatcatcctggatctggacatcgccctgaaggagcccgtcccctttccccggctccacgaggccctgggtcactttaggcgcggggcgctggcggcggttcagctgttgtttcccgcggcccgcgtagaccccgacgcctatccctgttattttttcaaaagcgcctgtcggccccgcgcgccgcccgtctgtgcgggcgacgggccctcggccggtggcgacgacggcgacggggactggttccccgacgccggtggtcccggcgacgaggagtgggaggaggacacggaccccatggacacgacccacggccccctcccggacgacgaggccgcgtacctcgacctgctacacgaacagataccagcggcgacgcccagcgaaccggactccgtcgtgtgttcctgcgccgacaagatcgggctgcgcgtgtgcctaccggtccccgccccgtacgttgtgcacggctccctgacgatgcgtggggtggcgagggtgatccagcaggcggtgctgttggaccgcgacttcgtggaggccgtagggagccacgtaaagaactttttgctgatcgatacgggcgtgtacgcccacggccacagcctgcgcttgccgtatttcgccaagatcggccccgacggctccgcgtgcggccggttattgcccgtcttcgtgatcccccccgcgtgcgaggacgttccggcgttcgtcgccgcgcacgccgacccgcggcgcttccactttcacgccccgcccatgttttccgcggccccgcgggagatccgcgtcctccacagcctgggcggggactatgtcagctttttcgagaagaaggcgtcgcgcaacgccctggagcactttgggcgacgcgagaccctgacggaggttctgggccgctacgatgtgcggcccgacgccggggagaccgtggaggggttcgcgtcagaactgctggggcgaatagtcgcgtgcatcgaggctcactttcccgagcacgcgcgggaatatcaggccgtgtccgttcgccgggccgtcattaaggacgactgggtcctgctgcagctgatccccggccgcggcgccctgaaccaaagcctctcgtgtctgcgcttcaagcacggcagggcaagtcgcgcgacggcccggacctttctcgcgctgagcgtcgggaccaacaaccgcctatgcgcgtccctgtgtcagcagtgctttgccactaaatgcgataacaaccgcctgcacacgctgtttaccgtcgatgcgggcacgccatgctcgcggtccgctccctccagcacctcacgaccgtcatcttcataacggcctacggcctcgtgctcgcgtggtacatcgtctttggtgccagtccgctccaccgatgtatttacgcggtgcgccccgccggggcgcacaacgataccgccctcgtgtggatgaagataaaccagacgctgttgtttctgggcccgccgaccgccccccccggcggggcatggaccccccacgcccgcgtctgctacgccaatatcatcgaaggtcgggccgtgtccctcccggccatccccggcgccatgagccgccgggtcatgaacgtgcacgaggccgtaaactgcttggaggccctctgggacacccagatgcgcctggtggtcgtcggttggtttctgtatctagcgttcgtcgcccttcaccaacgacgatgcatgttcggcgtcgtgagtcccgcgcacagcatggtggccccggcgacctatcttttgaactacgccggccgcatagtgtcgagcgtgttcttgcaatacccctacacgaaaatcacccgcctcctctgcgagctatccgttcaacgccagaccctggtgcagctgttcgaggcggatccggtcaccttcttgtaccaccgcccggccgttggcgtcatcgtgggctgcgagctgctgctccgcttcgtggccctcggtctcatcgtcggcaccgctctcatctcccggggcgcctgcgcgatcacacaccccctgtttctaacaatcaccacctggtgtttcgtgtccatcatcgccctgacggagctgtatttcatcctgcggcggggctcggcccccaaaaacgcggaaccagcggcccccagggggcgctccaaagggtggtcgggcgtctgcgggcgctgctgttccatcatcctctccggtatcgccgtgcgcctgtgctatatcgccgtcgtggccggggtggtgctcgtggcgcttcgctacgaacaggagattcagcggcgcctgtttgatctgtgacgtaacgcctcttccgttggaagaggcggacccagtcgcccatgcaaattaaatacacgacccgcctcgggcctacgcaccctcgcacgtcgcatgcaaattaaaatcgtgcacagagccgatccggcctcgggtctgcttgcccctcccccggcccagcacaggcaggctcgtccgacttccgcatacaccccaccctaccgcgtgcttccgcacccccgcctacgcgtgtacgcgaaggcggacccagacctgccgtatgctaattaaatacataaaacccaccctcggtgtccgattggtttctggggacggcgggggcgggggcggtgacgcccgacggggagggacaaggaggagtttcggaaagccggccccggtcgtgcgggtataagggcagccaccggcccactgggcgctgtgtgctgccgtgtgccgaccccggttgcgcgtcggtgccgctcctcgattcggacccggccactctcttccgacacgcgccccctcggaggacacccgccatcccagccccggcgacctacaacatggctaccgacattgatatgctaatcgacctaggattggacctgtccgacagcgagctcgaggaggacgctctggagcgggacgaggagggccgccgcgacgaccccgagtccgacagcagcggggagtgttcctcgtcggacgaggacatggaagacccctgcggagacggaggggcggaggccatcgacgcggcgattcccaaaggtcccccggcccgccccgaggacgccggcacccccgaagcctcgacgcctcgcccggcagcgcggcggggagccgacgatccgccacccgcgaccaccggcgtgtggtcgcgcctcgggaccaggcggtcggcttccccccgggaaccgcacggggggaaggtggcccgcatccaacccccgtcgaccaaggcaccgcatccccgaggcgggcggcgaggtcgccgccggggccggggtcgatacggccccggcggcgccgactccacaccaaacccccgccggcgcgtctccagaaacgcccacaaccaagggggtcgccaccccgcgtcggcgcggacggacggccccggcgccacccacggcgaggcgcggcgcggaggggagcagctcgacgtctccgggggcccgcggccacgaggcacgcgccaggccccccctccgctgatggcgctgtccctgacccccccgcacgcggacggccgcgccccggtcccggagcgaaaggcgccctctgccgacaccatcgaccccgccgttcgggcggttctgcgatccatatccgagcgcgcggcggtcgagcgcatcagcgaaagctttggacgcagtgccctggtcatgcaagacccctttggcgggatgccgtttcccgccgcgaacagcccctgggctcccgtgctggccacccaagcgggggggtttgacgccgagacccgtcgggtttcctgggaaaccctggtcgctcacggcccgagcctctaccgcacattcgcagccaacccgcgggccgcgtcgacagccaaggccatgcgcgactgcgtgctgcgccaggaaaatctcatcgaggccctggcgtccgcggatgagacgctggcgtggtgcaagatgtgcattcaccacaatctgccgctccgcccccaggaccctatcatcggaacggcggccgccgtgctggaaaacctcgccacgcgcctgcgcccctttctgcagtgctacctgaaggcccgaggcctgtgcgggctggacgacctgtgctcgcggcgacgcctgtcggacattaaggatattgcctcctttgtgttggtcatcctggcccgcctcgccaaccgcgtcgagcgcggcgtgtcggagatcgactacacgaccgtgggggttggggccggcgagacgatgcacttttacatcccgggggcctgcatggcgggtctcattgaaatactggacacgcaccgccaggagtgttccagtcgcgtgtgcgagctgacggccagtcacactatcgcccccttatatgtgcacggcaaatacttctactgcaactccctattttaggcaagaataaacatattgacgtcaacccaagtggttccgtgtgatgttcttggcgcgcgcggcgggtggggcggagactccggggcgatgccggcgtgcgcgtgggaggagggcgatgacccaccggataaatgtggggccccggcccggcccgcttcatagcgcgtccaggaactcacggcagacgcgtattcaccgacccccccctcgcaacatgacaacgacgcccctctcgaacctgtttttacgggccccggacatcacccacgtcgcccccccgtactgtctgaatgccacgtggcaggccgaaaacgccctgcacacgaccaaaacggaccccgcgtgcctggccgcgcggagttatttagtccgcgcctcctgctcgaccagcggccccatccactgttttttctttgcggtgtacaaggactcgcagcactcccttccgctggttaccgagctccgcaacttcgcggacctggtcaaccacccgcccgtcttgcgcgaactagaggataagcgtggggggcggctgcggtgcacgggcccattcagctgcggaaccatcaaggacgtctccggtgcatcccccgcgggggaatacacgataaacggtatcgtgtaccactgtcactgtcggtatccgttctccaaaacctgctggctcggggcatccgcggccctacaacaccttcgctctataagctcaagcggcacggccgctcgcgcggcagaacagcgacgccacaaaatcaaaatcaaaatcaaggtataacccacccccttccctccgagtccgtatgcaacctcattaataaagagtgagaaccaaccaaaacagacgcggtgtgagtttgtgggttataggaacccggtaaataccacgcgacgaaccagcatgtgtgttaacgcaacttttattcgttgtatcgcgggaggggggaagcttaccgccaaaggaaggccaagatgataacgacgaccaccgcgaccaccccaaaaaccgcatgacgacacgtcccgccacaccaccctggggcttggggcgtgtcggagctcgacgcacagcgggccgcgcgttgggcccggtacagctctcgcgaattgacaagcgggggtcgccacgtgcgcgagctttgcacgcggggttggtcggccggccccacggacccgcccggtggctcggtcggacatgcggccatgaccatggcgtaggtgggggggcgatccgaggtcgcctctgcgtaagtagggaggcccgacgggaggtcgcctcccacgccagggtgggccccaatcatagtttccggtagaaacaggggggtctccacaaacaacccccctgggccaaagctccggcgccgcgcccgtcgttcggcgcggcgcctggcgcgccgagcggcccgccaggcggcgcggcgcgagcggccacgctcacacacctcgccgtcaccggaagaagccggtgaaacaagcccaaccggcgacgtccctgcagagtacggtggaggcgagtccgtgggggtgtcgatatcaataacgacaaactggcccgcgctcgcgccggccacactctcgtatgggggcggggcgtcaatcacgctatcatctccgtcatccctgcatgcgtgggcatgcccagcccccaacgccatggtggggattcgcggctcagaagcctgcatgtcgtgtggtcggtcgtagtccaacgtgcctcccccacccaccacacagccggtccccacgccgaccactagaccgcagacgtcgcccaaccgaggtccccgtgcacagaccgcgccttttatagccccaggggttgctaattaacgcacgcatgcagacgcaatttattttgctcccccgcgtcctcccctcccctgcgcacacgtgataggtcttgggaacccgaggggcgacgcggggaaagcgcgcccccgcccggccgccgcgcgcccccgcccggccgccgcgcgcccccgcccggccgccgcgcgcccccgcccggccgccgcgcgcccccgcccggccgccgcgcgcccccgcccggccgccgcgcgcccccgcccggccgcccgcgtcgcgccggcgccccctcccggcgcttccggggtctttccttccttccccgccgcgaccccggccccgccccaccgccccgcccggcaggggggccccggcgccgcgcagaacacacagacgaacacacggtggcgatcttttctttacttcggcggaccagcgagccccggccccggcccgcgccccgccgccacacccacggcaccccccccccgccgcccaccccggggtccacacaggagcgcgcgggcggcagaaacgcgggcgcggcggcggtcggggtgggagtggtggtgggggacacgaaaacacacccacgacactctccccccaccccgaccgccgccgcgccccaccggcgggatcgcggcgagacgcagccgggcccccccccaccacccgcccacccacctaccccgcgcccgcagcctccggcagcacgccgaccaccgccgccaccccccaaacagccaaggcgcggtggggggcgtggtggtgaacgatggggggaacacgggggggaggggtccggggcgaggcgggcgggcgaaggaagggggggtggtggcggcggcggtggaaagcggaaaaacggaggatggaagggcagaagatggggagtcccgatcctcctcctgcatcccctcgccttccattctccggccctccgcgagtcccgacgccccccccccgccgcccgacgaaggagacccaagcaccgcagccggagaggccgagcggggagtgggcggccgggcgggaggatggcggagagagagagagagagagagagagggggggggggggagagggaaagcaacgggaaagagaggcgcgcggaaaagcagcaagaggggggacggggcgagccgggcagagtgcggagcccccggagcccgcggccgcagccgagcagcgccgcgggctccggggccgggccgggccggcaacgccccgcgccggccgcggcggagagaacccctgtgtcattgtttacgtggccgcgggccagcagacgggccgcgggccagcagacgggccgcggcgccagcggcccacgcctcccgccgcattaggcccccgcgggcatccggcggccggccccacgcccttccattaaacactcccacgttgggggggggcgcgccagctgagtgctctgcggttgcgggcgccgtgcccggagatccattaagccgccggagagcccgagccccgcccgcgtgttgctgtgggcatttctgctgcgtcatccctgtctttataaaaccgggggcgcggcagcaacgaacgcaggggcccgccgccgatcgagagggactccggagaaggaaggctgctccgcgcaccggcgcgcccttctcctctcccctccctacctccccctctcttcccccttttttcccccgcctcccgtcttcttccgcgcctccgagggtccgcctctgcctcggggacccccgggcgggccggggcttggccgccgaggtgcgccccggccggaggggcccccgcacctcggcggccgccccctccggcgccgcgcgttcgcgaaaggcgcgaaaggggcccccggaggcttttttcgattcccggccgggggtcccgggtagccgcccggcgccgggcggaaggcgtcccccgcccggcggtccggcccgggcccccggcggagcgcgggggccccggggccccgggccgcgccggcggcgtttccgcgttccgtttcttctccctcccggccgccccgctcccgggcccgaccctcgccccttcccttctcctcgtcttcccccgtcccgccgcgccccttccctcttccttctctctctctgtctcgctctcctcacatttcccccccccccccgccgccgccgccctctgcccgcgtcccaccgagacgccgcgccgcgtgagccgtccgccgggggacccaggctccggggggggggggcgcctgcgtgtgtctcgtgtgagagagcgcgcccctcgaacgccgcgcgttctcgcaggtaggtttagggtcgtacaggtgagcttctgctgaggcggcgggagagggggggggggcgggcggaagagagaagagagcaggggttgggggagaactgttcttcctccccctttcaagaaacacgaggcgggggtcccagaaagggcaggcaggtcagccgcaccgcccgcgagccaacccgtatcctttttttctaggtgtttttgtttttgtttctgtttttgtttgttttgttattattttcgcggatccggcgtgttcggatccaccccccctttctccttcctcttcccttccacccacccccgtttcccccccccgtggtgtcgtccgggggcgtcgttcccagggggggcaggcgcgggtcgggcccatacgcccaccgcccccacgcgccggtcacccccccccaacaaccccaaaggcgcgtgcccagccacagccgtgggtgtggcgcccgtccccttcctctaccgcgtgggcgcgggcgggggggtggtggtagtggtggcggaaggaaacgggccgggggccggggccgctagggaaaggtaggcacgcgcgcggtgtgtcgacttgcatgccccgcaaaacgcgtcgtgtcgtgttgtgtcgtggtgggccgtgttgtggtgggccgtgtggtgtggtgtggtgttgcgaacgcgcgagccccctcgccccgatgggagtctccccgcagccagggtaaggaggggcgggcgtggcgggcaggtgtgcgggcggggtggggtgagtgcggttgcatgcctcgggtctcctcttcctgctcctcctcctttctcccagccagggtgaggaggggcgggcgtggcgggcaggtgtgcgggcggggtgggcgccggggcgggggtgggcacgggcgtaagtgcgggtgcatgcctcgggtcttctcttctccctcctccttcctcccacccgtccccgggggcagagggcgtgcatgcgttgtgattcaaccgccctcgcccccgccccactttccccccctctctatcaaagttccctggcccctggcttcgcgccggtggtgcggctgaccccccccctcctccctccccgagccaggcgccctcccactcctgcccaccacccccagggtctggccggccagacgtgcgtgctctgcacgatcgggcccccctccctgtcaacacggacacactctttttttacccgccagccagcccgcccacccaccaagacagggagccagaacgcaggccgggccccggctctgttctatcataaagaccaacaggcctcgggggtgggggcggcttctcgtgcccgccccccctcctcctcctccctttccccccccccatccccggcccccctgcgcgggggagctgcatcaaaggccaacaacaaagtgtgtcaaaagcatcacaaaactttattgtaaaatttttataaatataaagttttttttcctcaagttttcaacaaggccagaaagtccataacaaaatgctggtgtgtgttgctgttcggggccgtgtccgtccccccccactcccacccccacttcctgtctcctccccgtctttcccccccacctccccctgcccccgaggcgcctcggccggtggtccggtggggggcggcttccctttgggcagcaagccgagtgttagctccccctactccccgtggcccgcgggggcgtcgccggccggcgcgggcgcgccctgctcccgagaccacgggtggcgcgaccggaggccgtggaagtccagcgcgcccaccagggtgccctggtcaaagagcatgttgcccaccggggtcatccagaggctgttccactccgacgcggggggcgtcgggtagtcggggggcctcacgcagttgcgcgcgtgctcggggagcagggtgcggcggctccacgcgggggccgcggcccgcagcaggtccgccacgttccccgtctggtccacgaggaccacgtaggcccctatgtggcccgtctccatgtccaggacgggcaggcagtcccccgtgaccgtcttgttcacgtaaggcgccagggccacgacgctcgagacccccgcgatgggcaggtagcgcgtgaggccgggcgccgggtcgcgggccccgggctcggggccgccctccgcgtggcgcgtcttcctggcacacttcctcggcccccgcggcgcagcagcgcgggggccgagggaggtttctcgtctctccccagcgccggacgcggacgcgacgctcccaccagccccgcccgcagaggaagaggcggaggaggaggaggaggaagaggaggcggcggaggaggaagaggcggcggaggaggaagaggaggcggcggaggaggaagaggaggcggcggaggaggaagaggaggcggcggaggaggaagaggaggcggcggcggcgaccgcggcctgggacgacggagacgccgacgggggcgcggcgcccgcggacgccggggcgagcggcccgtggccgcggtcgcccgagtccgagtccggggcccggcgcggcgccgccctcttggcccccaccccctggggggcgaggggcgagcgcggggcggcggaggaagaggcggaggacgaggccgcagggcccgagtccgacccgcgcctcttccgggggcgggccgccgccccctccgcggcgtggggggcggcaccgggggtgttggtgccgcgggggaccccgggtcctccctccgcgcccggccctcccgacccgcgcgcgtcggtcgcgcctgcccggcccagactctgtgcttgggtgtcggtctgagcctgggtcatgcgcgaccggggcgcgcggtgcgcgtccaccggcacggcgggcggcgcgggcccggccgcgtccgcgctcgcagacaccacgggggcggcggcggcgcggggcggactccggacgcgcggggcgacggccgcgcgggggcgcgccgcgcgccccgacgactgtggcagacctccccccccggggcccgaggacacctgcgcggaggaggaggagaaaaaggagagcggcccggggcccgcggggcggcgcggagacggcgggggagagtcgctgatgactatggggggctcctgggccgcgcggggctgtcccgcggggggcgtcctgccctccgccgccgcggcgtcttcgcccacccgccgcgcctgcgcgcgccccccgccggccgcagggggaagagaggccactctcggcacgacggccgcgacggcagggccgcccccagacccagatcccacccccgcccgcaacggggcgccgccgctgctgctgctccgcggggcgccagggggcgccggtcgggtcgcggcgggctgggaggttccgcgggtcgcccccgcaccgccgcccccgcgccggggcgctcttcggggggcgggcgggacgtagtccactgcagagggagacagagacgggagcccccggttagtgcccgacccccgcccgacccccgcccgacccccgcccgacccccgcccgacccccgcccgacccccgcccgacccccgcccgacccccgcccgacccccgcccgacccccgcccgacccccgcccgacccccgcccgccctcaccgtcggccaggtcatcgtcctcgtcgtccgtgccgggccacgggggggtgggcgacagggcgcggaccgtgtgtccccccagcgacagggagcgcggggccgtccgctggttgcccgtccagataaagtccacggccgtgccggcccgcacggccgcctcggcctccacgcgggtccgggggtcgttcactatcgggatggtgctgaacgacccgctggcggtcacgcccactatcaggtacgccaccggggtgttgcacaggggacacgtgttgcgcaacggaatccaggtcttcatgcacgggatgcagaaggggtgcaggcagggaaaactctggcagcgcaggggcggggcgatctcgtccgtgcacacggcgcacacgtcgcccccccctcccgcttccgcttcctcctcacccacgggcccacccccgcaggatccctgcgcgtcggcgggcgtggggctgccctggcgctcggccgggggccgggccgggggcgtggccgcgtccatcaggcccgcctcgaacatctccgtgtccgtgctgcccgcctcggaggtggagtcgcggtgaaggtcgtcgtcagagattcccacctcggtctcctcctccgagtcgctgctggcgagccactgcatgtcgttgagcatcccccaggcgtgcggggcggcgggctgcttgacaaagcaacgggggggatttagagggcgcggggcgtgaggcgggacccccgcgccgtgtcccccgtgtccctccctcaccccggccccccgcccgctgctttttgttcggaagggggggagaaaggggtccgtaaccaaaggtggtctgcgtcctttggattccgacccctcgtctccccccctgtcccccgctctcgggctcctccctgcctccctcgcccccccagagggtcggggggcggcgcacggcccacgggggtcccccgaccgcttaagcgggccgggggtcggccccgtcaagcgtccccgcccccgagcccaccgcccgcgaccacccccaacccgcagccgggtggtccggggaaaagggggggcctgagacccgggggtcgccctctcaccgtgccgggggtctgccgcggcggccgctcggggccggggtccgcccgggagctcgtgccgggccggggttccatgagccggggtagggtagactcgagacggcggcccgcggtctctctcttgccgggttttagtctctgtctctccgggtctcctcctcccgccgggccgccgctccgtcgctcgcagtgccggggtgcgaatgcggcccgaccgtcacacggggctgccttatacccggcgcctatccactcccccaaaggggcggcatttacgattcccccaatagccgcgcgccccggcgggggcggagggagggaatccccccctctcggggcggccccgtccccggggaccaaccgggtgtactccaagaaccccattagcatgcgccgccccccgccgacgcagatgggagtccccccggcgccccgccggcgcggccctgagtggtgcccgcccccggggagaaattcattagcatactaggaagcccaggggaccaataggggccgatcagcccacccacccggcggcgcgcgaggctctgcgtgttctgccaagaaagtaatcagcataacccggaaccccgagggagtaattacgcggggagcgaggggccgtccgaacgtttttaattaccataagcgggaatggcggcccgttaaaagctgctaattaccgcgagcgggaacgccggcccattaaaagttgctaattaccatgcgcggggatggcggccgggaccgcctattaaaagtttctaattaccataccgggaagccggtctagaggatccccgggtaccgagctcgaattcatcgatgatcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggatccatgtaccggatgcagctgctgagctgcatcgccctgagcctggccctggtgaccaacagcatgggcagcagccaccaccaccaccaccacagcagcggcctggtgccccggggcagccacatgcccaagaagaagatccagctgcacgccgagcacgccctgtacgacgccctgatgatcctgaacatcgtgaagaccaacagcccccccgccgaggagaagctggaggactacgccttcaacttcgagctgatcctggaggagatcgcccggctgttcgagagcggcgaccagaaggacgaggccgagaaggccaagcggatgaaggagtggatgaagcggatcaagaccaccgccagcgaggacgagcaggaggagatggccaacgccatcatcaccatcctgcagagctggatcttcagctgactcgagctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccaggttatccgtgtaaccgccagtccgtgcttgcctagcgaactcacccgtcccggctggcgtgcgcagcccgggccgtgttgcgggccctcttaaggggcggcggcaggacggggactcccgccccgcctcttttcccccggggagtcaacccccggggggggtgttttttgggggggggcgcgaaggcgggcggcggcggcgggcgggcggcagggcagccccgcgcgcccccttccccgtccctcccccggagccggccgctcccccgcgggcgccgcccctccccccgcgcgccgcggggctgccttcccgcgggcgcccccgcgcggcttttttcccgcgcccgcccccgcgcggcaagacggggactagcaggctgtgccgcagaccaccacacactcccaagctccccgcccccccgaagacgccagtcgcaccaccgctcgccctcgcagaccagacagttgcaccaagcacccgcccgcccgcacacggttccccgccaccccctccctcccctccatcccgccgagctcgcggcagcccctcccccccgcgcgccacggggctgcggtcccgcggccgcctcccccgcggccgcctcccccgcgccccgccccgggggcttcccccgcccctccccccgcgcccgcggccccgagctcgcagcagcccctccctcccgcgccccgtgccttccctcccgctcctgcgggggggctcgggccacctgaccttcgtaacctgcactcaggtcagagccccagaccccccgcgggcgcgggagacgtgccgcccacccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgaataaaccacacaaggcggtacgttttcgtctgtctcgttctttatttctcacacacgcgcgcggccatcgccgcgtctgtcttaaaggcgcacagacgcccgattccttccccctctccccatctcccccctcccccgctcccggaagtttcccccccgtcactccccaaacagtccgtcgtcgtcgtcctccagctccgcgtccatgtccacgggctcgcgcctcggcggcgtggccagccccgcggcggtccccaccacctccacgccgccgcccgccgcggccagcaccgtccccgcgcggcccgcggccgacgcccagcgtatctgcgggggcgggcccgcgtccgcgtcgtcgcgcagcaccagcgggggcgcgtcgccgtcgggctcgagcagcgcccgcgcgcagaactcccgccgcggcccgcgcagctccgccgggccgccgcgcacggcgtcgcgccccagcgccacgtagacgggccgcagcggcgcgcccaggccccagcgcgcgcaggcgcggtgcgagtgcgcctcgtcctcgcagaagtccggcgcgccgggcgccatggcgtcgcccgcgcccgaggcggcggcccggccgtccagcgccgggagcacggcgcggcggtactcgcgcggggacatgggcaccagcgtgtcggggccgaagcgcgtgcgcacgcggtaccgcacgttggccccgcggcagaggcgcagcggcggcgcgtcggggtacaggcgcgcgtgcgcggcctccacgcgcgcgaagacccccggcccgaacacgcggccggaggccagcacggtgcggcgcaggtcccgcgccgccggccagcgcacggcgcactgcacggcgggcagcacctcgcaggccaggtaggcgtgctgccgcgagaccacgggcccgtcggcgggccagtccgcggcgcgcacggcgttgacgacgatgaggcggcggtcgcaggcgccggccagcagccccaggaactccacggcgccggcgaaggccaggtcccgcgtggacagcagcagcacgccctgcgcgcccagcgccgagacgtcgggggcgccggtccagttgcccgcccaggcggccgtggcgggcccgcagagccggttgcccagggccgccagcaggcaggacagcccgccgcgctcggcggaccactccggggggggcccgcccccggcgcggcccgcggccaggtcctcgcccggcagcggcgagtagaggatcaccacgcgcacgtcctccgggtcgggcacctggcgcatccaggccgccgcgcggcgcagcgggcccgaggcgcgcagcgggccgaaggcggcgggcgcgccgccggggggcggggcggcgcagcgcgcggccagcgaggccagcgcgcgcgggtcgaacatgagggccgggcgccacggcgcggggaagagcgggtggtccgtgagctcggccacggcccgcggggcgcagtaggcctccagggcggcggccgagggcgccggcgtgtggctgggccccggcggctggcggcgccagccgccctgcgggtcggggccctcggcgggccggcgggtcagcgccgcggggcgcggcggccgcggcggcggcgtcggcggggcggggggcgcggcccccgcgggaggggcggccgcggggcggggggcgtccgcgcggctcttcttcggggggcgcggggcgccgcccggcggcgccctggccggggcggggctcttgcgcttgcgcgcctcccgcggcgcggaggcgggcgcggcgagcgagtcggccgcggcgacggtgtcggccagcagggggcgcaggctctggttctggaagagcaggtccgcggcggcggcggcggcggagctcagcaggcgcgggctccgcggcagcgccgggcccagggccccggcgaccaggctcacggcgcgcacggcggccacggcggcctcgctgccgccggccacgcgcaggtccccgcgcaggcgcatcagcaccagcgcgtcgcgcacgaaccgcagctcgcgcagccaggcgcgcaggcggggcgcgtcggcgtgcggcggggcggccgcgcccgcgggccccgggcgcgggggcgcggcgggccgggctccggccagccccggcacggccgccaggtcgccgtcgaagccctccgccagcgcctccaggatcccgcggcaggcggccaggcactccacggccacgcggcccgcctccgcgcgccggccgccgccaccaccgccggcgccgtcgtcgtcgtcgtcgtcgtcggccccggccggcgcggaggcgggcgcggcgctcaggcgccccagggcggcgagcacccccgcggcgccgtagccggcgggcaccgcgcgctcgtcggccggcgacgccgccgccgacggcaacggggcggcggcggcggcgggcttcccgcgggcgtcgtcgccgtcgtggcggttggcgtcgccgccgtcgtcgggggttcgcgccccggtcagcgccgcgttctcgcgcgccagcaggggcgcgtaggcgcggcgcaggctggtcagcaggaagcccttctgcgcgcggtcgtagcggcggctcatggccacggcggccgccacgtgcgccaggccccagccgaagcggcccgccgccatggcgtaccccaggtggggcacggcccgcgccacgctgccggagatgaaggagctgctgttgcgcgccgcgcccgagatccggaagcaggcctggtccagcgccacgtccccgggcgccacgcgcgggttctggagccaccccatcgcctccgcgtccggcgtgtacagcagccgcgtgatcagggcgtactgctgcgccgcgtcgcccagctcgggcgcccacacgggcgccggggcgcccgaggcctcgaaccgggcccgcgcctcctccgcctcgggcgccccccagaggccggggcggctgtcgcccagcccgccgtacagcacgcgccccgggggcggggggccggccccgggccacggctccccgctgacgtacccgtcgcggtagcgcgcgtagaaggcgccggaggccgcgtcggcgtccagctcgacccgccggggccgcccggccgtgaagcggcccgtggcgtcgcggccggccaccgccgcgcgggcccggcggcgctccaggcggcccgcggtcgccgcgggggtccgggccggggcgggctcggccctgggcgggctcggccggggcgccgcccccggggccctcgcgggcacccccgcctcctcgtcgtccgcgccgagggtcccgcccgcggcgtggtctgcggcgctggcgggggcgcgggcggcgtcgtcgtcgtcgtcgtcgtcagacgaggaggcggatgcagacgaggaggaggaggcggaggaggaggcggaggacgccgacgacgaggatccggattttgatgagtcagaggcggccgagcgccggcggggggcgcgccggcggcggtggtggtggtggtggtggtgtcggcggggcgccgggggtcgcggcgacaggctggccatggggtccgggtacgccccgcggaccgcggacgtcgtctccggtccgcggacccagcggcccgcgtcgcggtcgtcgtcatcgtcgtcgtcgtcgtcgtcgtcgttctcctcgccataatcggcgcgcatggagggggtccgcggcggagaaggcgagcgggccgcttcttcttccgcgccgtcgcgctccggggggggcgacgggatcgtgcgaacggcctcgtccaccatcgaggccagcagggccagctgccgcggcgagacgacgccgtccgcggcaggctcgtcgacggcctccccggacgccggggccgcctcgtcggcatcggcatcggcggcggcgtcgtcggcctcgtcttcgttctcctccggcccaccgtgccacccgaacccgggccgcgcggcggggcgacggtccgggttcggggtgggcggcggtccgtcggctggatccggagatccggggccgccggtcgtctccgccgcggcccggagacgtcccccgtcctcgtccgccatcgcgacctcggccccgcggccctgcgtcgtcgtcgtcgtcttcttcttcttccgctgctccgccgacatcgcctccgaccggggtgtgcgggggggggtcttcttcttcttcttcaggggcggcagtgggggggggtggttggcagtctctctcccccccgtgcggtgcgtgcgtgtgcctgtgtcttttcgcctctccgcgccgatcgggtagatcctggcggccgcgtcggtagccgcgctccgtgtggacgatcgccccgtcgcctggctgatatagtcctcggggcgcgcggggcggggggaaaggaggaggacgcggaggaggagcgatcgacgccgccgcgccccggctcgccggggttccgcccccaggtggaaccgcattatgcgcggccccgccccgacgcccgcgcgtccgcgtccgtggcggcggcccgttggtcgcgccgccgccggctccgcccgcgcggcatctcattagcgcccggcgcgggcggcttccgcttccgcccgcgatgctaatgagaccctcgtcgcgggcgggctcgctcccctgcccttccgggttcgtggtaatgagatgccggccccgcgctcccgttggcccccgccggccccaaaggggccggcgaggtcgccccgttggtccgcgggcggctccgccccaaagggggcggggccgcagggtaaaagaagtgagaacgcgaagcgttcgcacttcgtcctaatagtatatatattattagggcaaagtgcgagcgctggcgccctgcccggggcccgcgtcatcccgcgggctccgccccaaagggggcggggccgcagggtaaaagaagtgagaacgcgaagcgttcgcacttcgtcctaatagtatatatattattagggcaaagtgcgagcactggcgccctgcccggggcccgcgtcatcccgcgggctccgccccgaggcgggcccggacggggggcgggccgttcctcgcgcacataaagggccggcgtcccggtcgccgccgcaccaggggcacaccggctgcgcggcggagaccgggacggcagcggcggcatcgcgaagggggccacagcgagacagagacgccggcggcgagcggggcaccgacgcacccggatcggatcggatacagagacgcgggcgcatcggttccttttcgttctgcctttccctcccccccccccccccaccctgtacgtaccgcgaggacccatccacccactgcagccttatcgcaggtacggtgacccggggggccgggccggggggacgggccggggggacgggccggggggacgggccggggggacgggccggggggacgggccggggggacgggccggggggacgggccggggggacgggccggggggccggggggccggggggccggggggacggggggacgggccggggggacgggccggggggccggggggacggggggacggggggacggggggacggggggacggggggacggggggacggggggacggggggacggggggacggggggacggggggacggggggacggggggacggggggacgggccggggggacggggggacgggccggggggacggggggacggggccccgatcccaacatccgcgctttctcgcaggccgggcgccgccttcgtggacgggacaccggtgtggtaactggcgacaaggcgttgccactatggcagacatccccccggacccgcccgcgctcaacacgacgcctgcgaatcatgctcccccatccccacccccgggttcacggaagcgcagacgccccgtcctccccagctcgtcggaatctgagggtaagcccgacacagaatcggaatcctcctcgaccgagtcgtccgaggatgaggcgggagacctacgcggcgggcgccgtcgctccccgcgggagctcggggggaggtattttttggatctgtcggcagaatcgaccacggggacggaatcggagggaacggggccgtcggacgacgatgatgatgatgcgtcagacggctggttggttgacacacccccccgcaaatccaagcgaccccgaatcaacctgcgattaacgagctcccccgaccggcgtgcgggtgtggttttccccgaggtgtggagaagcgacagacctatccgcgcggcgcaaccccaggccccggcccagtcttccggggatcgcgcagccgcaccgcggcgctctgctcgccaggcccagatgcggagcggagccgcctggacgcttgatctgcattacatacgccagtgcgtcaaccagctctttcggatcctgcgtgccgccccgaacccgcccggcagcgccaaccgcctgcgccacctggtgcgagactgctacctcatgggctactgccggacccgcctggggccgcgcacgtggggccgcctgctgcagatctcgggcggaacctgggacgtgcgcctgcgaaacgcaatccgggaggtcgaggcgcattttgaacccgccgccgagcccgtgtgcgagctgccctgtctgaacgccaggcgttacggccccgagtgtgatgttggcaatctcgagaccaacggcggctcgacgagcgatgatgagatatcggatgcgacggactcggacgataccctcgcgtcccattccgacacggagggggggccctccccggccggccgggagaacccggaatccgcgtccggcggggctatcgcggctcggctggagtgtgagtttgggacgtttgactggacgtccgaggagggctcccagccctggctgtccgcggtggtcgccgataccagctccgccgaacgctctggcctacccgccccgggcgcgtgtcgcgcaacggaagccccagaacgcgaggacgggtgccgaaaaatgcgcttccccgccgcctgcccctatccctgcggccacacatttctccggccatgagcgcgggacccccagcccggtgtgtttgccaaacgaaaaataaacgccctacaagaaagcttttgtgtctgagtgtctggtttttctgggggtggaggaaggaacgacaaaaaaaagaaacaaacgcgacaccgctcgtacgtgtaatggggcgcagtgttttttattagcatcggggggggttagaggttggtgattggatagcaaacgtgggatgacggaggccactcgtcgccaacggccagcgggggcccggggttctgggggtcatcgtcccccgtctgccaggagggctcatcgggaatctcgggtcgccccatgcacgtaaaacacgggcgctgcgtggggtgggtcgccggatgcgggcgggatgatgcggggcggggtttgttgtgaggagccacgagggaccgtagccagcgaagacagctgcgttcccggtcgccgggcaccaccacgccgtattggtattcgtatcggctaaggagattttccagggggtgattaggcgctgcggggaacggggtccacgacacggtccgctcgggcaaaaaccgatcgggcaggggccacggttcccccacccacgcgtcgttggtcttcgtggcgatgaagcgaaaccccagccgggttttttgtgcgtactcgaaaaacggcacacacaggtccgccgccccgaccacccacaggtggtatagccggtgggggccggggcgctcttgatgcaggagccgaaaacacgcaggggcatccagaatctcgatgctttccagggggtcgtcctccgcaaacaggcccgtcgtggtgtttgggggacagcgacaggagcgggttcgcacgatcggtcgggtgaatttgggcaagtccatcagaggctcggccagcctgcgaaggttcgccgggcgaaccaccaccggggttcccagaggctcggaggccaggatccggcattgccgaagcagaaaactccacagagccgggcttgcgtcagcggaagtccgcggcagggcgtttcgttggtctaggagggtaaccacacttacaacaacaacgcccatgtcggtatattaggcccgtggtccgatcttcactcactcgcctgtctgcggacctatgcacggcgggacggcgcgcggacccgggggggctgcttgctatcacacggcccgttcgcacgttcgattttttcagccttgtttggttggctaggtatcccggataatctgacgttccggatatagggggcggggggtagtggggggtgtgtcgacaaactgccgcttcttaaaacaccggggcccgtcgctcggggtgctcgttggttggcacgcgcgacgcggcaaatggcctgtcgtaagttctgtggggtctaccgtagacccgacaagagacaggaggcgtccgtcccgccggagacaaacacggccccggccttcccggcgagcaccttttatacccccgcggaggatgcgtacctggcccccgggcccccggaaaccatccacccttcccgcccaccgtcccccggcgaggctgcgcgcctgtgtcagctgcaggagatcttggcccagatgcacagcgacgaggactaccccatcgtggacgccgcgggtgcggaggaggaagacgaggccgacgatgacgccccggatgacgtggcctacccggaggactacgcggaggggcgttttctgtccatggtttcggccgcccccctgcccggagccagcggccatcctcctgttccgggccgcgcagccccccccgacgtccggacctgcgacagcggtaaggtgggggccacggggttcaccccggaagagctcgacaccatggaccgggaggcacttcgggccatcagccgcgggtgcaagcccccttcgaccctggcaaaactggtgaccgggctgggattcgcgatccacggagcgctcatcccggggtcggaggggtgtgtctttgatagcagccacccgaactaccctcatcgggtaatcgtcaaggcggggtggtacgccagcacgagccacgaggcgcggctgctgagacgcctgaaccaccccgcgatcctacccctcctggacctgcacgtcgtttctggggtcacgtgtctggtcctccccaagtatcactgcgacctgtatacctatctgagcaagcgcccgtctccgttgggccacctacagataaccgcggtctcccggcagctcttgagcgccatcgactacgtccactgcgaaggcatcatccaccgcgatattaagaccgagaacatcttcatcaacacccccgagaacatctgtctgggggactttggggcggcgtgctttgtgcgcgggtgtcgatcgagccccttccattacgggatcgcaggcaccatcgatacaaacgcccccgaggtcctggccggggatccgtacacccaggtaatcgacatctggagcgccggcctggtgatctttgagaccgccgtccacaccgcgtccttgttctcggccccgcgcgaccccgaaaggcggccgtgcgacaaccagatcgcgcgcatcatccgacaggcccaggtacacgtcgacgagtttccgacgcacgcggaatcgcgcctcaccgcgcactaccgctcgcgggcggccgggaacaatcgtccggcgtggacccgaccggcgtggacccgctactacaagatccacacagacgtcgaatatctcatatgcaaagcccttacctttgacgcggcgctccgcccaagcgccgcggagttgctgcgcctgccgctatttcaccctaagtgaccccgctccccccggggggcgtggaggggggggctggttggatgtttttgcacaaaaagacgcggccctcgggctttggtgtttttggcaccttgccgcccggcgtcatgcacgccatcgctcccaggttgcttcttctttttgttctttctggtcttccggggacacgcggcgggtcgggtgtccccggaccaattaatccccccaacagcgatgttgttttcccgggaggttcccccgtggctcaatattgttatgcctatccccggttggacgatcccgggcccttgggttccgcggacgccgggcggcaagacctgccccggcgcgtcgtccgtcacgagcccctgggccgctcgttcctcacgggggggctggttttgctggcgccgccggtacgcggatttggcgcacccaacgcaacgtatgcggcccgtgtgacgtactaccggctcacccgcgcctgccgtcagcccatcctccttcggcagtatggagggtgtcgcggcggcgagccgccgtccccaaagacgtgcgggtcgtacacgtacacgtaccagggcggcgggcctccgacccggtacgctctcgtaaatgcttccctgctggtgccgatctgggaccgcgccgcggagacattcgagtaccagatcgaactcggcggcgagctgcacgtgggtctgttgtgggtagaggtgggcggggagggccccggccccaccgcccccccacaggcggcgcgtgcggagggcggcccgtgcgtccccccggtccccgcgggccgcccgtggcgctcggtgcccccggtatggtattccgcccccaaccccgggtttcgtggcctgcgtttccgggagcgctgtctgcccccacagacgcccgccgcccccagcgacctaccacgcgtcgcttttgctccccagagcctgctggtggggattacgggccgcacgtttattcggatggcacgacccacggaagacgtcggggtcctgccgccccattgggcccccggggccctagatgacggtccgtacgcccccttcccaccccgcccgcggtttcgacgcgccctgcggacagaccccgagggggtcgaccccgacgttcgggccccccgaaccgggcggcgcctcatggccttgaccgaggacacgtcctccgattcgcctacgtccgctccggagaagacgcccctccctgtgtcggccaccgccatggcaccctcagtcgacccaagcgcggaaccgaccgcccccgcaaccactactccccccgacgagatggccacacaagccgcaacggtcgccgttacgccggaggaaacggcagtcgcctccccgcccgcgactgcatccgtggagtcgtcgccactccccgccgcggcggcggcaacgcccggggccgggcacacgaacaccagcagcgcctccgcagcgaaaacgccccccaccacaccagcccccacgacccccccgcccacgtctacccacgcgaccccccgccccacgactccggggccccaaacaacccctcccggacccgcaaccccgggtccggtgggcgcctccgccgcgcccacggccgattcccccctcaccgcctcgccccccgctaccgcgccggggccctcggccgccaacgtttcggtcgccgcgaccaccgccacgcccggaacccggggcaccgcccgtacccccccaacggacccaaagacgcacccacacggacccgcggacgctccccccggctcgccagcccccccaccccccgaacatcgcggcggacccgaggagtttgagggcgccggggacggcgaaccccccgaggacgacgacagcgccaccggcctcgccttccgaactccgaaccccaacaaaccaccccccgcgcgccccgggcccatccgccccacgctcccgccaggaattcttgggccgctcgcccccaacacgcctcgcccccccgcccaagctcccgctaaggacatgccctcgggccccacaccccaacacatccccctgttctggttcctaacggcctcccctgctctagatatcctctttatcatcagcaccaccatccacacggcggcgttcgtttgtctggtcgccttggcagcacaactttggcgcggccgggcggggcgcaggcgatacgcgcacccgagcgtgcgttacgtatgtctgccacccgagcgggattagggggtgggggtggggggcgagaaacgatgaaggacgggaaagggaacagcgaccaaatgtcacgataagaacaataaacctgtgacgtcaatcagatatgtgagtttggttgtgttttgtgggactgggggcggggggtgggaggtatcagtgggtgacagagtcttttaaaagacgtgtcccggggccctcgagacgcgcaacttttggccacacagagaaaggcccccagacgaagtcacccgggtccccgaacaaaaacaaaaaccttgaccgccgccggggggcgtgcctgttgttttggtctcaatggatcggtatgccgttcggacctgggggattgtgggaatcctcgggtgtgctgctgttggggccgcacccaccggccccgcgtccgatacaacaaacgcgaccgcacgcctccccacgcaccccccactcatccgttccgggggctttgccgtccccctcatcgtgggggggctgtgtctcatgattctggggatggcgtgtctactcgaggtcctgcgtcgcctgggtcgcgagttggcgaggtgctgcccccacgcgggccaatttgccccatgatttttcgcctttctggccttgcccccaccccatcgccccgattgtgtgtcgggtgcccggggtacagcagctatggagcggtcggtaatataactttggttgtcgccacacgccccgtgccgggcatgggttgtgcgggaaggacgaaataatccggcgatccccaagcgtaccaactgggggggggggggggaaaagaaactaaaaacacatcaagcccacaacccatcccacaatgggggttatggcggacccaccgcaccaccatactccgattcgaccacatatgcaaccaaatcacccccagaggggaggttccatttttacgaggaggaggagtataatagagtctttgtgtttaaaacccggggtcggtgtggtgttcggtcataagctgcattgcgaacgactagtcgccgtttttcgtgtgcatcgcgtatcacggcatggggcgtttgacctccggcgtcgggacggcggccctgctagttgtcgcggtgggactccgcgtcgtctgcgccaaatacgccttagcagacccctcgcttaagatggccgatcccaatcgatttcgcgggaagaaccttccggttttggaccagctgaccgacccccccggggtgaagcgtgtttaccacattcagccgagcctggaggacccgttccagccccccagcatcccgatcactgtgtactacgcagtgctggaacgtgcctgccgcagcgtgctcctacatgccccatcggaggccccccagatcgtgcgcggggcttcggacgaggcccgaaagcacacgtacaacctgaccatcgcctggtatcgcatgggagacaattgcgctatccccatcacggttatggaatacaccgagtgcccctacaacaagtcgttgggggtctgccccatccgaacgcagccccgctggagctactatgacagctttagcgccgtcagcgaggataacctgggattcctgatgcacgcccccgccttcgagaccgcgggtacgtacctgcggctagtgaagataaacgactggacggagatcacacaatttatcctggagcaccgggcccgcgcctcctgcaagtacgctctccccctgcgcatccccccggcagcgtgcctcacctcgaaggcctaccaacagggcgtgacggtcgacagcatcgggatgctaccccgctttatccccgaaaaccagcgcaccgtcgccctatacagcttaaaaatcgccgggtggcacggccccaagcccccgtacaccagcaccctgctgccgccggagctgtccgacaccaccaacgccacgcaacccgaactcgttccggaagaccccgaggactcggccctcttagaggatcccgccgggacggtgtcttcgcagatccccccaaactggcacatcccgtcgatccaggacgtcgcgccgcaccacgcccccgccgcccccagcaacccgggcctgatcatcggcgcgctggccggcagtaccctggcggtgctggtcatcggcggtattgcgttttgggtacgccgccgcgctcagatggcccccaagcgcctacgtctcccccacatccgggatgacgacgcgcccccctcgcaccagccattgttttactagaggagtttccccgctcccgtgtacctctgggcccgtgtgggagggtggctggggtatttgggtgggacttggactccgcataaagggagtctcgaaggagggaaactaggacagttcataggccgggagcgtggggcgcgcaccgctgtcccgacgattagccaccgcgcccacagccacctcgacccgtccgatcccggtatgcccggccgctcgctgcagggcctggcgatcctgggcctgtgggtctgcgccaccggcctggtcgtccgcggccccacggtcagtctggtctcagactcactcgtggatgccggggccgtggggccccagggcttcgtggaagaggacctgcgtgttttcggggagcttcattttgtgggggcccaggtcccccacacaaactactacgacggcatcatcgagctgtttcactaccccctggggaaccactgcccccgcgttgtacacgtggtcacactgaccgcatgcccccgccgccccgccgtggcgttcaccttgtgtcgctcgacgcaccacgcccacagccccgcctatccgaccctggagctgggtctggcgcggcagccgcttctgcgggttcgaacggcaacgcgcgactatgccggtctgtatgtcctgcgcgtatgggtcggcagcgcgacgaacgccagccggtttgttttgggggtggcgctctctgccaacgggacgtttgtgtataacggctcggactacggctcctgcgatccggcgcagcttcccttttcggccccgcgcctgggaccctcgagcgtatacacccccggagcctcccgacccacccctccacggacaacgacacccccgtcctccccccgagacccgacccccgcccccggggacacagggacgcccgcgcccgcgagcggcgagatagccccgcccaattccacgcgatcggccagcgaatcgagacacaggctaaccgtagcccaggtaatccagatcgccataccggcgtccatcatcgcctttgtgtttctgggcagctgtatctgcttcatccatagatgccagcgccgatacaggcgcccccgcggccagatttacaaccccgggggcgtttcctgcgcggtcaacgaggcggccatggcccgcctcggagccgagctgcgatcccacccaaacaccccccccaaaccccgacgccgttcgtcgtcgtccacgaccatgccttccctaacgtcgatagctgaggaatcggagccaggtccagtcgtgctgctgtccgtcagtcctcggccccgcagtggcccgacggccccccaagaggtctaggtccaagcgggccgttcggcaggcccgccccaccgcccccatcgtggttatttccccccccccccaataaaccgatgttatttgcctatatgcgtgtgttggatccctttgtgatcgttcgtcattccccggatggcatgggaggcgggtaatggatgggcggggcccgggggggaggaaaaagaataaagggggtagtgtcggagaggcccgccgcgcatttaaggagtcgccgccccgactctgtgtcttcgggtgacttggtgcgccgccgtcagctagtctccgatctgccccgaccgacggctcctgccacccgaacatggctcgcggggccgggttggtgttttttgttggagtttgggtcgtatcgtgcctggcggcagcacccagaacgtcctggaaacgggtaacctcgggcgaggacgtggtgttgcttccggcgcccgcggaacgcacccgggcccacaaactactgtgggccgcggaacccctggatgcctgcggtcccctgcgcccgtcgtgggtggcgctgtggcccccccgacgggtgctcgagacggtcgtggatgcggcgtgcatgcgcgccccggaaccgctcgccatagcatacagtcccccgttccccgcgggcgacgagggactgtattcggagttggcgtggcgcgatcgcgtagccgtggtcaacgagagtctggtcatctacggggccctggagacggacagcggtctgtacaccctgtccgtggtcggcctaagcgacgaggcgcgccaagtggcgtcggtggttctggtcgtggagcccgcccctgtgccgaccccgacccccgacgactacgacgaagaagacgacgcgggcgtgagcgaacgcacgccggtcagcgttccccccccaacccccccccgtcgtccccccgtcgcccccccgacgcaccctcgtgttatccccgaggtgtcccacgtgcgcggggtaacggtccatatggagaccccggaggccattctgtttgcccccggggagacgtttgggacgaacgtctccatccacgccattgcccacgacgacggtccgtacgccatggacgtcgtctggatgcggtttgacgtgccgtcctcgtgcgccgagatgcggatctacgaagcttgtctgtatcacccgcagcttccagagtgtctatctccggccgacgcgccgtgcgccgtaagttcctgggcgtaccgcctggcggtccgcagctacgccggctgttccaggactacgcccccgccgcgatgttttgccgaggctcgcatggaaccggtcccggggttggcgtggctggcctccaccgtcaatctggaattccagcacgcctccccccagcacgccggcctctacctgtgcgtggtgtacgtggacgatcatatccacgcctggggccacatgaccatcagcaccgcggcgcagtaccggaacgcggtggtggaacagcacctcccccagcgccagcccgagcccgtcgagcccacccgcccgcacgtgagagccccccatcccgcgccctccgcgcgcggcccgctgcgcctcggggcggtgctgggggcggccctgttgctggccgccctcgggctgtccgcgtgggcgtgcatgacctgctggcgcaggcgctcctggcgggcggttaaaagccgggcctcggcgacgggccccacttacattcgcgtggcggacagcgagctgtacgcggactggagttcggacagcgagggggagcgcgacgggtccctgtggcaggaccctccggagagacccgactctccctccacaaatggatccggctttgagatcttatcaccaacggctccgtctgtatacccccatagcgaggggcgtaaatctcgccgcccgctcaccacctttggttcgggaagcccgggccgtcgtcactcccaggcctcctatccgtccgtcctctggtaaggcgtcttccgacgacgcggacgtcggcgatgaactgattgccatcgcggacgcacgcggggacccgccagagaccctgccccccggcgcgggcggcgccgcgcccgcgtgccgcagaccacctcgcggcggctcccccgcggcctttcccgtggccctccacgccgtggacgccccctcccaattcgtcacctggctcgccgtgcgctggctgcggggggcggtgggtctcggggccgtcctgtgcgggattgcgttttacgtgacgtcaatcgcccgaggcgcataaaggtccggcggccagccccgccgcagctcataaaaatcgtgagtcacggcaaccgcaccttcgcctccggccctccgccagcgcccttccgcgtccgcgatgacctcccggcccgccgaccaagactcggtgcgttccagcgcgtcggtgccgctttaccccgcggcctcgcccgtcccggcagaagcctactactcggaaagcgaagacgaggccgccaacgacttcctcgtgcgcatgggccgccagcagtcggtcctaaggcgccgacggcggcgcacgcggtgcgtcgggctggttatcgcctgtctcgtcgtggccctcctatctggagggttcggggcacttttggtgtggctgctccgctaaatgacgcctcgatgtatggcgccttcttcgcccccacccctcgccgcgacccacgtccgtatgttaattgcaataaagtggttgattgtcattacggtctactaggttgtcttttttttttgggggggggggaggaaatgcagaaaagggtaagaaattctcggaatttcacccccgggggggggcaagtgcagtaacccagttcctcagtgtttgggaaatctattgaactctcccggctcctccgtgttagggaagtctcttggggaaatctattgacctctcgccccccccccccaggaggggggcagtgcagtaccccagttcctccgtgctggggaaatctctctgccgggtacgggctccagacgaaggacccatacatttccccatccgcaccccacatctggcgttctagagtcacgacgcatttgcccccgtccccgcagcaacacacaaagcgatttcaattttcacgattttattattaattacaccaaccaccctgtccccgggacgtggtcaggaccgggggtccgcacccaaacgcacgaaacaaatgctggcagtgtgccgaatataaccccgcgtaggaacacgtcgacgcgtgcgccaaacagcaccagaaggcgcatgccatcagcaggtcgtgcatatggcgatgtgtttggacgcagggcgcagccgcggcgataaaattcatggcggccgtccgccagggccacagcggcgaggactccctgttggcccgaagccattgggtatgaaccagctgcgcctcctgtccgaccctggctcccgccagcgggggcggtgggtcgtgggtgttgagagcacacaggcgggacacctcgatcaccgtccgaaaaaaggcccggtggtccgcgggcagcatctgcaggtgcgccagggcctgggcgttgagagggtacaactcggagccgggggactccgggggccggtccgcgcggtgccgcgagttggcacgctttggggcccgggtgtcggacgcgggcgcgttatggatcccgacgcggggcagaacgtacgtgcgttggcgcggcgatgaggggtccgggctgccgaggggggcgtaggggaccgggctaggcaagcccgcgggttgcgcggggttcccgtgggggtctaggctccctgggcacccgtgggggtcgtgggggtcgcgggtccctgggtatgcgcgggaccctgggttctctgggagatcgtggaactcgcggttccctgggctctcggggaacccggggctccctggggacacgtggtgccctgggaattcttgatggtcggacggcttcagatggcttcgggatcgagagggccgcacagactcgtagtagacccgaatctccacgtttccccgccgccggatcatggtcgccgccccggtgcgggggcccgtcggtcggaagcgagtgcccttcaagcgtgtccgctcctctgggctgcatgccgtcggatggggtgccttttaaggaaaggtctcggctgcccgccccaaccggggtttgggggtgggccggggaaaccccggatgccatgggggggtcacaccctaagcgccggcgcgctggttgggtgggggtagaggggagtccccggtcgacgagatcgtataagctgggtaccgagctcgaattcatcgatgatatcagatcgatccccatggtgtcccgtccacgaaggcggcgcccggcctgcgagaaagcgcggatgttgggatcggggccccgtccccccgttccccggcccgtccccccgtccccccggcccgtccccccggcccgtccccccggcccggccccccgggtcaccgtacctgcgataaggctgcagtgggtggatgggtcctcgcggtacgtacagggtgggggggggggggggagggaaaggcagaacgaaaaggaaccgatgcgcccgcgtctctgtatccgatccgatccgggtgcgtcggtgccccgctcgccgccggcgtctctgtctcgctgtggcccccttcgcgatgccgccgctgccgtcccggtctccgccgcgcagccggtgtgcccctggtgcggcggcgaccgggacgccggccctttatgtgcgcgaggaacggcccgccccccgtccgggcccgcctcggggcggagcccgcgggatgacgcgggccccgggcagggcgccagtgctcgcactttgccctaataatatatatactattaggacgaagtgcgaacgcttcgcgttctcacttcttttaccctgcggccccgccccctttggggcggagcccgcgggatgacgcgggccccgggcagggcgccagcgctcgcactttgccctaataatatatatactattaggacgaagtgcgaacgcttcgcgttctcacttcttttaccctgcggccccgccccctttggggcggagccgcccgcggaccaacggggcgacctcgccggcccctttggggccggcgggggccaacgggagcgcggggccggcatctcattaccacgaacccggaagggcaggggagcgagcccgcccgcgacgagggtctcattagcatcgcgggcggaagcggaagccgcccgcgccgggcgctaatgagatgccgcgcgggcggagccggcggcggcgcgaccaacgggccgccgccacggacgcggacgcgcgggcgtcggggcggggccgcgcataatgcggttccacctgggggcggaaccccggcgagccggggcgcggcggcgtcgatcgctcctcctccgcgtcctcctcctttccccccgccccgcgcgccccgaggactatatcagccaggcgacggggcgatcgtccacacggagcgcggctaccgacgcggccgccaggatctacccgatcggcgcggagaggcgaaaagacacaggcacacgcacgcaccgcacgggggggagagagactgccaaccacccccccccactgccgcccctgaagaagaagaagaagacccccccccgcacaccccggtcggaggcgatgtcggcggagcagcggaagaagaagaagacgacgacgacgacgcagggccgcggggccgaggtcgcgatggcggacgaggacgggggacgtctccgggccgcggcggagacgaccggcggccccggatctccggatccagccgacggaccgccgcccaccccgaacccggaccgtcgccccgccgcgcggcccgggttcgggtggcacggtgggccggaggagaacgaagacgaggccgacgacgccgccgccgatgccgatgccgacgaggcggccccggcgtccggggaggccgtcgacgagcctgccgcggacggcgtcgtctcgccgcggcagctggccctgctggcctcgatggtggacgaggccgttcgcacgatcccgtcgccccccccggagcgcgacggcgcggaagaagaagcggcccgctcgccttctccgccgcggaccccctccatgcgcgccgattatggcgaggagaacgacgacgacgacgacgacgacgatgacgacgaccgcgacgcgggccgctgggtccgcggaccggagacgacgtccgcggtccgcggggcgtacccggaccccatggccagcctgtcgccgcgacccccggcgccccgccgacaccaccaccaccaccaccaccgccgccggcgcgccccccgccggcgctcggccgcctctgactcatcaaaatccggatcctcgtcgtcggcgtcctccgcctcctcctccgcctcctcctcctcgtctgcatccgcctcctcgtctgacgacgacgacgacgacgacgccgcccgcgcccccgccagcgccgcagaccacgccgcgggcgggaccctcggcgcggacgacgaggaggcgggggtgcccgcgagggccccgggggcggcgccccggccgagcccgcccagggccgagcccgccccggcccggacccccgcggcgaccgcgggccgcctggagcgccgccgggcccgcgcggcggtggccggccgcgacgccacgggccgcttcacggccgggcggccccggcgggtcgagctggacgccgacgcggcctccggcgccttctacgcgcgctaccgcgacgggtacgtcagcggggagccgtggcccggggccggccccccgcccccggggcgcgtgctgtacggcgggctgggcgacagccgccccggcctctggggggcgcccgaggcggaggaggcgcgggcccggttcgaggcctcgggcgccccggcgcccgtgtgggcgcccgagctgggcgacgcggcgcagcagtacgccctgatcacgcggctgctgtacacgccggacgcggaggcgatggggtggctccagaacccgcgcgtggcgcccggggacgtggcgctggaccaggcctgcttccggatctcgggcgcggcgcgcaacagcagctccttcatctccggcagcgtggcgcgggccgtgccccacctggggtacgccatggcggcgggccgcttcggctggggcctggcgcacgtggcggccgccgtggccatgagccgccgctacgaccgcgcgcagaagggcttcctgctgaccagcctgcgccgcgcctacgcgcccctgctggcgcgcgagaacgcggcgctgaccggggcgcgaacccccgacgacggcggcgacgccaaccgccacgacggcgacgacgcccgcgggaagcccgccgccgccgccgccccgttgccgtcggcggcggcgtcgccggccgacgagcgcgcggtgcccgccggctacggcgccgcgggggtgctcgccgccctggggcgcctgagcgccgcgcccgcctccgcgccggccggggccgacgacgacgacgacgacgacggcgccggcggtggtggcggcggccggcgcgcggaggcgggccgcgtggccgtggagtgcctggccgcctgccgcgggatcctggaggcgctggcggagggcttcgacggcgacctggcggccgtgccggggctggccggagcccggcccgccgcgcccccgcgcccggggcccgcgggcgcggccgccccgccgcacgccgacgcgccccgcctgcgcgcctggctgcgcgagctgcggttcgtgcgcgacgcgctggtgctgatgcgcctgcgcggggacctgcgcgtggccggcggcagcgaggccgccgtggccgccgtgcgcgccgtgagcctggtcgccggggccctgggcccggcgctgccgcggagcccgcgcctgctgagctccgccgccgccgccgccgcggacctgctcttccagaaccagagcctgcgccccctgctggccgacaccgtcgccgcggccgactcgctcgccgcgcccgcctccgcgccgcgggaggcgcgcaagcgcaagagccccgccccggccagggcgccgccgggcggcgccccgcgccccccgaagaagagccgcgcggacgccccccgccccgcggccgcccctcccgcgggggccgcgccccccgccccgccgacgccgccgccgcggccgccgcgccccgcggcgctgacccgccggcccgccgagggccccgacccgcagggcggctggcgccgccagccgccggggcccagccacacgccggcgccctcggccgccgccctggaggcctactgcgccccgcgggccgtggccgagctcacggaccacccgctcttccccgcgccgtggcgcccggccctcatgttcgacccgcgcgcgctggcctcgctggccgcgcgctgcgccgccccgccccccggcggcgcgcccgccgccttcggcccgctgcgcgcctcgggcccgctgcgccgcgcggcggcctggatgcgccaggtgcccgacccggaggacgtgcgcgtggtgatcctctactcgccgctgccgggcgaggacctggccgcgggccgcgccgggggcgggccccccccggagtggtccgccgagcgcggcgggctgtcctgcctgctggcggccctgggcaaccggctctgcgggcccgccacggccgcctgggcgggcaactggaccggcgcccccgacgtctcggcgctgggcgcgcagggcgtgctgctgctgtccacgcgggacctggccttcgccggcgccgtggagttcctggggctgctggccggcgcctgcgaccgccgcctcatcgtcgtcaacgccgtgcgcgccgcggactggcccgccgacgggcccgtggtctcgcggcagcacgcctacctggcctgcgaggtgctgcccgccgtgcagtgcgccgtgcgctggccggcggcgcgggacctgcgccgcaccgtgctggcctccggccgcgtgttcgggccgggggtcttcgcgcgcgtggaggccgcgcacgcgcgcctgtaccccgacgcgccgccgctgcgcctctgccgcggggccaacgtgcggtaccgcgtgcgcacgcgcttcggccccgacacgctggtgcccatgtccccgcgcgagtaccgccgcgccgtgctcccggcgctggacggccgggccgccgcctcgggcgcgggcgacgccatggcgcccggcgcgccggacttctgcgaggacgaggcgcactcgcaccgcgcctgcgcgcgctggggcctgggcgcgccgctgcggcccgtctacgtggcgctggggcgcgacgccgtgcgcggcggcccggcggagctgcgcgggccgcggcgggagttctgcgcgcgggcgctgctcgagcccgacggcgacgcgcccccgctggtgctgcgcgacgacgcggacgcgggcccgcccccgcagatacgctgggcgtcggccgcgggccgcgcggggacggtgctggccgcggcgggcggcggcgtggaggtggtggggaccgccgcggggctggccacgccgccgaggcgcgagcccgtggacatggacgcggagctggaggacgacgacgacggactgtttggggagtgacgggggggaaacttccgggagcgggggaggggggagatggggagagggggaaggaatcgggcgtctgtgcgcctttaagacagacgcggcgatggccgcgcgcgtgtgtgagaaataaagaacgagacagacgaaaacgtaccgccttgtgtggtttattcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggtgggcggcacgtctcccgcgcccgcggggggtctggggctctgacctgagtgcaggttacgaaggtcaggtggcccgagcccccccgcaggagcgggagggaaggcacggggcgcgggagggaggggctgctgcgagctcggggccgcgggcgcggggggaggggcgggggaagcccccggggcggggcgcgggggaggcggccgcgggggaggcggccgcgggaccgcagccccgtggcgcgcgggggggaggggctgccgcgagctcggcgggatggaggggagggagggggtggcggggaaccgtgtgcgggcgggcgggtgcttggtgcaactgtctggtctgcgagggcgagcggtggtgcgactggcgtcttcgggggggcggggagcttgggagtgtgtggtggtctgcggcacagcctgctagtccccgtcttgccgcgcgggggcgggcgcgggaaaaaagccgcgcgggggcgcccgcgggaaggcagccccgcggcgcgcggggggaggggcggcgcccgcgggggagcggccggctccgggggagggacggggaagggggcgcgcggggctgccctgccgcccgcccgccgccgccgcccgccttcgcgcccccccccaaaaaacaccccccccgggggttgactccccgggggaaaagaggcggggcggg

SEQ ID NO: 20 - DNA, 154823 bp, synthetic construct
  source 1..154823: mol_type = other DNA
agtccccgtcttgccgcgcgggggcgggcgcgggaaaaaagccgcgcgggggcgcccgcgggaaggcagccccgcggcgcgcggggggaggggcggcgcccgcgggggagcggccggctccgggggagggacggggaagggggcgcgcggggctgccctgccgcccgcccgccgccgccgcccgccttcgcgcccccccccaaaaaacaccccccccgggggttgactccccgggggaaaagaggcggggcgggagtccccgtcctgccgccgccccttaagagggcccgcaacacggcccgggctgcgcacgccagccgggacgggtgagttcgctaggcaagcacggactggcggttacacggataacctggttctttccgcctcagaagccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagcatttaggtgacactatagaatagggccctctagctcgagttaggacgtgttgatgaacatttggacaatgcgtataaagctttgcaaaaactctgtgaaggttttctcctccagctcctcacattccttgcagccagattctgctacattcttgttagaagacagagtgctgtttgcaaggtagagcacgtttcttactgtttcattaagagtcatgttactgtactcatgtaaaataacctgcaattccaggagaaagcagttcattgcagtaactttgcaactgggatgaaagtcactgtcagtgtataaagtggtgtcaatatgaatagattgaataaggctttcaattttctccaggtcatatcttacatctatccagttggcctctgttttagggagacctacactgacacagcccaaaatgaagacatgaatgccagcctcagttaaaaagtgactgtttagaaggaaacacaagtagcacgagatggatgtattcctcatatatggtttcaaaattttcatggatccagcttgggtctccctatagtgagtcgtattaatttcgataagccagtaagcagtgggttctctagttagccagagagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacgcgtatatctggcccgtacatcgatcatcgatgaattcgagctcggtacccggggatcctctagaccggcttcccggtatggtaattagaaacttttaataggcggtcccggccgccatccccgcgcatggtaattagcaacttttaatgggccggcgttcccgctcgcggtaattagcagcttttaacgggccgccattcccgcttatggtaattaaaaacgttcggacggcccctcgctccccgcgtaattactccctcggggttccgggttatgctgattactttcttggcagaacacgcagagcctcgcgcgccgccgggtgggtgggctgatcggcccctattggtcccctgggcttcctagtatgctaatgaatttctccccgggggcgggcaccactcagggccgcgccggcggggcgccggggggactcccatctgcgtcggcggggggcggcgcatgctaatggggttcttggagtacacccggttggtccccggggacggggccgccccgagagggggggattccctccctccgcccccgccggggcgcgcggctattgggggaatcgtaaatgccgcccctttgggggagtggataggcgccgggtataaggcagccccgtgtgacggtcgggccgcattcgcaccccggcactgcgagcgacggagcggcggcccggcgggaggaggagacccggagagacagagactaaaacccggcaagagagagaccgcgggccgccgtctcgagtctaccctaccccggctcatggaaccccggcccggcacgagctcccgggcggaccccggccccgagcggccgccgcggcagacccccggcacggtgagagggcgacccccgggtctcaggcccccccttttccccggaccacccggctgcgggttgggggtggtcgcgggcggtgggctcgggggcggggacgcttgacggggccgacccccggcccgcttaagcggtcgggggacccccgtgggccgtgcgccgccccccgaccctctgggggggcgagggaggcagggaggagcccgagagcgggggacagggggggagacgaggggtcggaatccaaaggacgcagaccacctttggttacggacccctttctcccccccttccgaacaaaaagcagcgggcggggggccggggtgagggagggacacgggggacacggcgcgggggtcccgcctcacgccccgcgccctctaaatcccccccgttgctttgtcaagcagcccgccgccccgcacgcctgggggatgctcaacgacatgcagtggctcgccagcagcgactcggaggaggagaccgaggtgggaatctctgacgacgaccttcaccgcgactccacctccgaggcgggcagcacggacacggagatgttcgaggcgggcctgatggacgcggccacgcccccggcccggcccccggccgagcgccagggcagccccacgcccgccgacgcgcagggatcctgcgggggtgggcccgtgggtgaggaggaagcggaagcgggaggggggggcgacgtgtgcgccgtgtgcacggacgagatcgccccgcccctgcgctgccagagttttccctgcctgcaccccttctgcatcccgtgcatgaagacctggattccgttgcgcaacacgtgtcccctgtgcaacaccccggtggcgtacctgatagtgggcgtgaccgccagcgggtcgttcagcaccatcccgatagtgaacgacccccggacccgcgtggaggccgaggcggccgtgcgggccggcacggccgtggactttatctggacgggcaaccagcggacggccccgcgctccctgtcgctggggggacacacggtccgcgccctgtcgcccacccccccgtggcccggcacggacgacgaggacgatgacctggccgacggtgagggcgggcgggggtcgggcgggggtcgggcgggggtcgggcgggggtcgggcgggggtcgggcgggggtcgggcgggggtcgggcgggggtcgggcgggggtcgggcgggggtcgggcgggggtcgggcgggggtcgggcactaaccgggggctcccgtctctgtctccctctgcagtggactacgtcccgcccgccccccgaagagcgccccggcgcgggggcggcggtgcgggggcgacccgcggaacctcccagcccgccgcgacccgaccggcgccccctggcgccccgcggagcagcagcagcggcggcgccccgttgcgggcgggggtgggatctgggtctgggggcggccctgccgtcgcggccgtcgtgccgagagtggcctctcttccccctgcggccggcggggggcgcgcgcaggcgcggcgggtgggcgaagacgccgcggcggcggagggcaggacgccccccgcgggacagccccgcgcggcccaggagccccccatagtcatcagcgactctcccccgccgtctccgcgccgccccgcgggccccgggccgctctcctttttctcctcctcctccgcgcaggtgtcctcgggccccggggggggaggtctgccacagtcgtcggggcgcgcggcgcgcccccgcgcggccgtcgccccgcgcgtccggagtccgccccgcgccgccgccgcccccgtggtgtctgcgagcgcggacgcggccgggcccgcgccgcccgccgtgccggtggacgcgcaccgcgcgccccggtcgcgcatgacccaggctcagaccgacacccaagcacagagtctgggccgggcaggcgcgaccgacgcgcgcgggtcgggagggccgggcgcggagggaggacccggggtcccccgcggcaccaacacccccggtgccgccccccacgccgcggagggggcggcggcccgcccccggaagaggcgcgggtcggactcgggccctgcggcctcgtcctccgcctcttcctccgccgccccgcgctcgcccctcgccccccagggggtgggggccaagagggcggcgccgcgccgggccccggactcggactcgggcgaccgcggccacgggccgctcgccccggcgtccgcgggcgccgcgcccccgtcggcgtctccgtcgtcccaggccgcggtcgccgccgccgcctcctcttcctcctccgccgcctcctcttcctcctccgccgcctcctcttcctcctccgccgcctcctcttcctcctccgccgcctcttcctcctccgccgcctcctcttcctcctcctcctcctccgcctcttcctctgcgggcggggctggtgggagcgtcgcgtccgcgtccggcgctggggagagacgagaaacctccctcggcccccgcgctgctgcgccgcgggggccgaggaagtgtgccaggaagacgcgccacgcggagggcggccccgagcccggggcccgcgacccggcgcccggcctcacgcgctacctgcccatcgcgggggtctcgagcgtcgtggccctggcgccttacgtgaacaagacggtcacgggggactgcctgcccgtcctggacatggagacgggccacataggggcctacgtggtcctcgtggaccagacggggaacgtggcggacctgctgcgggccgcggcccccgcgtggagccgccgcaccctgctccccgagcacgcgcgcaactgcgtgaggccccccgactacccgacgccccccgcgtcggagtggaacagcctctggatgaccccggtgggcaacatgctctttgaccagggcaccctggtgggcgcgctggacttccacggcctccggtcgcgccacccgtggtctcgggagcagggcgcgcccgcgccggccggcgacgcccccgcgggccacggggagtagggggagctaacactcggcttgctgcccaaagggaagccgccccccaccggaccaccggccgaggcgcctcgggggcagggggaggtgggggggaaagacggggaggagacaggaagtgggggtgggagtggggggggacggacacggccccgaacagcaacacacaccagcattttgttatggactttctggccttgttgaaaacttgaggaaaaaaaactttatatttataaaaattttacaataaagttttgtgatgcttttgacacactttgttgttggcctttgatgcagctcccccgcgcaggggggccggggatggggggggggaaagggaggaggaggagggggggcgggcacgagaagccgcccccacccccgaggcctgttggtctttatgatagaacagagccggggcccggcctgcgttctggctccctgtcttggtgggtgggcgggctggctggcgggtaaaaaaagagtgtgtccgtgttgacagggaggggggcccgatcgtgcagagcacgcacgtctggccggccagaccctgggggtggtgggcaggagtgggagggcgcctggctcggggagggaggagggggggggtcagccgcaccaccggcgcgaagccaggggccagggaactttgatagagagggggggaaagtggggcgggggcgagggcggttgaatcacaacgcatgcacgccctctgcccccggggacgggtgggaggaaggaggagggagaagagaagacccgaggcatgcacccgcacttacgcccgtgcccacccccgccccggcgcccaccccgcccgcacacctgcccgccacgcccgcccctcctcaccctggctgggagaaaggaggaggagcaggaagaggagacccgaggcatgcaaccgcactcaccccaccccgcccgcacacctgcccgccacgcccgcccctccttaccctggctgcggggagactcccatcggggcgagggggctcgcgcgttcgcaacaccacaccacaccacacggcccaccacaacacggcccaccacgacacaacacgacacgacgcgttttgcggggcatgcaagtcgacacaccgcgcgcgtgcctacctttccctagcggccccggcccccggcccgtttccttccgccaccactaccaccacccccccgcccgcgcccacgcggtagaggaaggggacgggcgccacacccacggctgtggctgggcacgcgcctttggggttgttgggggggggtgaccggcgcgtgggggcggtgggcgtatgggcccgacccgcgcctgccccccctgggaacgacgcccccggacgacaccacgggggggggaaacgggggtgggtggaagggaagaggaaggagaaagggggggtggatccgaacacgccggatccgcgaaaataataacaaaacaaacaaaaacagaaacaaaaacaaaaacacctagaaaaaaaggatacgggttggctcgcgggcggtgcggctgacctgcctgccctttctgggacccccgcctcgtgtttcttgaaagggggaggaagaacagttctcccccaacccctgctctcttctctcttccgcccgccccccccccctctcccgccgcctcagcagaagctcacctgtacgaccctaaacctacctgcgagaacgcgcggcgttcgaggggcgcgctctctcacacgagacacacgcaggcgccccccccccccggagcctgggtcccccggcggacggctcacgcggcgcggcgtctcggtgggacgcgggcagagggcggcggcggcgggggggggggggaaatgtgaggagagcgagacagagagagagaaggaagagggaaggggcgcggcgggacgggggaagacgaggagaagggaaggggcgagggtcgggcccgggagcggggcggccgggagggagaagaaacggaacgcggaaacgccgccggcgcggcccggggccccggggcccccgcgctccgccgggggcccgggccggaccgccgggcgggggacgccttccgcccggcgccgggcggctacccgggacccccggccgggaatcgaaaaaagcctccgggggcccctttcgcgcctttcgcgaacgcgcggcgccggagggggcggccgccgaggtgcgggggcccctccggccggggcgcacctcggcggccaagccccggcccgcccgggggtccccgaggcagaggcggaccctcggaggcgcggaagaagacgggaggcgggggaaaaaagggggaagagagggggaggtagggaggggagaggagaagggcgcgccggtgcgcggagcagccttccttctccggagtccctctcgatcggcggcgggcccctgcgttcgttgctgccgcgcccccggttttataaagacagggatgacgcagcagaaatgcccacagcaacacgcgggcggggctcgggctctccggcggcttaatggatctccgggcacggcgcccgcaaccgcagagcactcagctggcgcgcccccccccaacgtgggagtgtttaatggaagggcgtggggccggccgccggatgcccgcgggggcctaatgcggcgggaggcgtgggccgctggcgccgcggcccgtctgctggcccgcggcccgtctgctggcccgcggccacgtaaacaatgacacaggggttctctccgccgcggccggcgcggggcgttgccggcccggcccggccccggagcccgcggcgctgctcggctgcggccgcgggctccgggggctccgcactctgcccggctcgccccgtcccccctcttgctgcttttccgcgcgcctctctttcccgttgctttccctctccccccccccccctctctctctctctctctctctctccgccatcctcccgcccggccgcccactccccgctcggcctctccggctgcggtgcttgggtctccttcgtcgggcggcggggggggggcgtcgggactcgcggagggccggagaatggaaggcgaggggatgcaggaggaggatcgggactccccatcttctgcccttccatcctccgtttttccgctttccaccgccgccgccaccacccccccttccttcgcccgcccgcctcgccccggacccctcccccccgtgttccccccatcgttcaccaccacgccccccaccgcgccttggctgtttggggggtggcggcggtggtcggcgtgctgccggaggctgcgggcgcggggtaggtgggtgggcgggtggtgggggggggcccggctgcgtctcgccgcgatcccgccggtggggcgcggcggcggtcggggtggggggagagtgtcgtgggtgtgttttcgtgtcccccaccaccactcccaccccgaccgccgccgcgcccgcgtttctgccgcccgcgcgctcctgtgtggaccccggggtgggcggcggggggggggtgccgtgggtgtggcggcggggcgcgggccggggccggggctcgctggtccgccgaagtaaagaaaagatcgccaccgtgtgttcgtctgtgtgttctgcgcggcgccggggcccccctgccgggcggggcggtggggcggggccggggtcgcggcggggaaggaaggaaagaccccggaagcgccgggagggggcgccggcgcgacgcgggcggccgggcgggggcgcgcggcggccgggcgggggcgcgcggcggccgggcgggggcgcgcggcggccgggcgggggcgcgcggcggccgggcgggggcgcgcggcggccgggcgggggcgcgcggcggccgggcgggggcgcgctttccccgcgtcgcccctcgggttcccaagacctatcacgtgtgcgcaggggaggggaggacgcgggggaggggaggacgcgggggaggggaggacgcgggggatatataaagcggtagaaagcgcgggaatgggcatattggacccgcgtgattcggttgctcgcggttgtcttgtttggacgttttttatgcgggaacaagggggcttaccggttacactgtccgctcgctatggggttcgtctgtctgtttgggcttgtcgttatgggagcctggggggcgtggggtgggtcacaggcaaccgaatatgttcttcgtagtgttattgccaaagaggtgggggacatactaagagtgccttgcatgcggacccccgcggacgatgtttcttggcgctacgaggccccgtccgttattgactatgcccgcatagacggaatatttcttcgctatcactgcccggggttggacacgtttttgtgggataggcacgcccagagggcgtatctggttaacccctttctctttgcggcgggatttttggaggacttgagtcactctgtgtttccggccgacacccaggaaacaacgacgcgccgggccctttataaagagatacgcgatgcgttgggcagtcgaaaacaggccgtcagccacgcacccgtcagggccgggtgtgtaaactttgactactcacgcactcgccgctgcgtcgggcgacgcgatttacggcctgccaacaccacgtcaacgtgggaaccgcctgtgtcgtcggacgatgaagcgagctcgcagtcgaagcccctcgccacccagccgcccgtcctcgccctttcgaacgcccccccacggcgggtctccccgacgcgaggtcggcgccggcatactcgcctccgacgcaactagccacgtctgcatcgcaagccaccctgggtcgggagcaggacagccgacccgtctagcggccgggtcggctgtccagcgtcgtcgccctagaggctgtccgccgggcgtgatgttttccgcatctacgacccccgaacagcccctggggctgtcgggcgatgcgacgccgcccctgccgacttccgtgcccctggactgggccgcgtttcggcgcgcgtttctgatcgacgacgcctggcggcccctgttggagccggagctcgcgaaccccctaaccgcgcgcctcctcgcggagtatgaccgtcggtgccagaccgaagaggtgctgccgccgcgggaggatgtgttctcctggacgcggtattgtacccccgacgacgtgcgcgtggttatcatcgggcaggacccgtaccaccatcccggccaggcgcacggcctggcgtttagcgtgcgtgcggatgtgccggtgcctccgagtctacggaacgtgctggcggcggttaaaaattgttaccccgacgcgcgcatgagcggccgcggctgcctggaaaagtgggctcgcgacggcgtgctgttgttgaacacgaccctgaccgtcaagcgcggggcggcggcgtcccactccaagcttggatgggaccgttttgtgggcggggtggtccgacggctggccgcgcgccgcccgggcctggtctttatgctctggggcgcccatgcccagaacgcgatcaggcccgaccctcgccaacactacgtcctcaagttttctcacccgtcgcccctctccaaggtcccgtttgggacgtgccagcatttcctcgccgcgaatcgctacctcgaaacccgggacattatgccgatcgactggtcggtataagatgccgacatccggggtcttgatttacgagggggcaattaataaagactgttgatggttaaatctcgggtctcataccggtccgtgatgtcgggcgtgggggaagagagggtcccctctgcgtttactatccttgcctcgtggggctggacgtttgcaccccagaaccatgatcctggcgcgtcgccgaatacgacgcccatagagtcgattgcggggaccgcaccggacgcgcacgtggggcctctcgacggagagccggaccgggatgcgatctccccgcttacgtcgagcgtggccggcgacccgccgggggcggacggcccctacgtcacctttgatactctgtttatggtatcttcgatcgacgaactggggcgccgccagctcacggatacgatccgtaaggacctgcggctgtcgctggccaagttcagcatcgcgtgtaccaagacctcgtcgttttcggggacggccgcgcgccagcgcaagcgcggagcaccgccgcaacgcacatgcgtaccacgcagcaacaagagcctccagatgttcgttttgtgcaagcgcgccaacgccgcgcaggtgcgcgagcagctgcgggcggttattcggtcgcgcaagccgcgcaagtattacacgcggtcctcggatgggcggctctgcccggccgtccccgtgtttgtacacgagtttgtttcgtccgaacccatgcgcctccatcgagataacgtcatgctgtctacggaaccagactaagcacccccgccgtcccctttcttttccccctacccttccccccgttactgatgtgttgtgacgtttcaataaataacacgtagcttattttgttggatgatggattgattgattttattgaccgttcgttcgcccggcggtgccgtcgccgcgcgcagagggaatatgcaagcgggcggggtggggaggaaagaaggtttcaggttccgggggttgggtctgcgtcgtccagggtggggctgatctgaatttcccgcagaacctcgaccagtaggtctgttgtgtttgctgggaactcgcccgccgttggggatacgggggcggggggtgtggtcgggcggacgtccaggggtgcgttatcgcacccccgcgccgcctcgggggccgtcccgtagatcgttgcggtgatgtagatggtgtccggggtccacaccaccgtcaggatgccggccgtcgcactccggacgctttcgccgtgcgatgagctgacccaggagtcaaaggggtacgcgtacatatgggcgtcccaccagcgctccagcctctgggtactagcgcgtcctataaagcggtatgcgcaaaattcggcacgacagtcgataatcaccagcagcccgatgggggtgtgttgtatcaccacgcctccgcggggcaggcggtcctggcgcgctcgaccccgcgtcagaaccgcgcgcgtccctgactcaaacacgtgcaccacctgtgccgcgtccggcagcgcgctcgttagcgacgccctggggtgatgtaggctgtacgcgatggtcgtctgggggttccccatgtctcgggggggtgggggtgaatgtcacccggcccgggtgcggtgggaacgcgagggaatggagggttaatagacaatgaccacattcggatcgcgtagagcagatagtatgtgctcgctaatgacgtcatcgcgttcgtggcgctcccggagcgggtttagattcatgtgcaggaactcggatgaggtggtgcgggacatggctacgtacgcgctgtttaggcgcaggtttccgggcgtgaagcatatggcgaccttgtccagactgagcccctgggagcgcgtgatggtcatcgcgagtttggagctgatgccgtagtcggcgttgatggccatggccagctccgtggagtcgatcgactcgacaaactcactgatgttggtattgacgacagacatgaagccgtgctggtcccgcaggacgatgtagggcaggggggactcctccaagaactcggccacgccggccgtcgcgtgccgccgccgcagctcctccgcgaacgcgaacacccgggtgtacgtgtaccccatcagcgtgtagttgtccgtctgcagggccacggacatcagccccccgcgcggcgagccggtcagcagctcgcagccccggaaaatgacattgtccacgtaggtgctgaagggggcgctctcaaacacctccccgaagagctcccgtaggataaggtatcgccccagaaaggccctcttcaggagcccaaactgggcgtggacggccgcggtggtctcaggctcttcgagggcgtagtggcagtagaacacgtccagctgctgttcgtccagcccggcgaagataacgtcaaggtcgtcgtcggggaagtcgtccgggcccccgtcccgcgggcccaggtgcttaaaattgaacgcacgctcccccggagagcggtcgctggtgtcggcggccctggttgccgatgcgccggcggcgtcccggcgtagcgacaggagttctgccgtcagctcccctaggcggccgtaggccagggtcctctgggtcgcgtccaggccggggcgctggagaaagttgtaaaagtgaatcagcccgccgaacatgagccgcgacaggaaccggtaggcgaactccaccgaggtctccccctgggtcttcacgaagctgtcgtcgcgcagcacagcctcgaaggtccgaaacgtcccgtcgaacccaaacaccatctttcggaggcgcgcggtcaccgcgacctggctgttgaggacgtacgtgatgtcgttccgggccacgactagctgttgcttgctgtgcacctcacagcgcacgtgccccgcgtcctggtcctgactctgggagtagttggtgatgcgactggcgttggccgtgatccacttttccatggtcagcgtgggttgctgcgtgagccgtcgatactcgtcaaactctttgaccgacacaaacgtgagcacggggagggtaaacacaacaaactccccctcgcgagtcacctttaggtaggcgtggagcttggccatgtacgcgctgacctccttgtgggacgagaacagccgcgtccaccccggaaggttggccgggttggtgatgtaactttccgggacgacaaagcggtccacaaactgcatgtgctcctcggtgatgggaaggccgtactccagcaccttcatgaggttcccgaactcgtgctccacacatcgcttgttgttaatgaaaatggcccagctgtgcgagaggcgcgtgtactcgcgtagggtgcggttgcagatgaggtacgtgagcacgttttcgctctgccggacggagcatcgcagtttttggtgttcgaaggtggactccagcgaggccgtctgggtcggcgaccccacgcacaccagcaccggccgcaggcggcccgcgtactggggggtgtggtacagggcgttaatcatccaccagcaatacaccacggtcgtgagtaggtgccgccccaggagcccggcctcgtcgatgacgataatgttgctgcgggtgaaagccggcagcgccccgtgtgtgaccgaggccaggcgcgtgagggcaccctggcccagccccaaagtctgctctagggcggtgagggcgtggaactcgtttcgcgcgtcttcgcccccgtgcgccgccagggcccgcttggtgatgtcgaggatcacctcccagtagtacgtcaggtctcgccgctgcaggtcttccagcgaggcggggctgctggccagggtgtacgggtgctgccccagctgggcctggacgtgattcccgcgaaacccgaactcgtgaaagatggtgttgatgggtcgactcagaaacgcccccgagagcttaacgtacatgttctgcgccgcgattcgcgtggcgcccgtgaccacgcagtccaggacctcgttgagggtctgcacgcacgtactctttccggatccggcgttgccggtgatgagatacgccgcgaacggaaactcccggagcggcaggccggtcgggacctccaaggccgccacgtcccggaaccactgcaggcgcggcacctgcgtgacgtcgagctgctgctgcgagagctctcggatgcgtgcgatgattggttggaccccgtgcatggacgtaaaatttaaaaacgcctcgtccctgaaccgcacggcgggtctggccccgggctgctgtgggggcggacctggtgcccggacgtcccgcgagccctccccgccggacgccgccatggccgcacagcgcgcgcgggcgccggcgatgcggacgcggggcggcgacgcggcgctatgcgcccccgaggacggctgggtgaaggttcaccccacccccgggacgatgttgttccgcgagattctcctcgggcagatggggtacaccgagggtcagggggtgtacaacgtcgtccggtccagcgaggccgccacccgacagctgcaggcggcgatcttccacgcgctcctcaacgccacgacgtaccgggacctggaggaggactggcgccgccacgtggtggcccgcggcctccagccgcagcggctggttcgcaggtaccggaacgcccgggagggcgatatcgccggggtggccgagcgggtgttcgacacgtggcgatgcacgctcaggacgacgctgctggactttgcccacggggtggtagactgctttgcgccgggcggcccaagcggaccgaccagcttccccaaatatatcgactggctgacgtgtctggggctggttcccatattgcgcaagacgcgcgagggggaggcgacgcagcgcctgggggcgtttctcaggcagcacacgctgccccggcagctggccacggtcgccggggccgcggagcgcgccggcccggggcttctggatctggccgtcgcgttcgactccacgcgcatggcggaatacgaccgcgtgcacatctactacaaccatcgccggggggagtggctggtgcgcgacccggtcagcgggcagcgcggcgagtgcctggtgctgtgcccccccctgtggaccggcgaccgcctggtcttcgattcgcccgttcagcggctgtgccccgagatcgtcgcgtgccacgccctccgggaacacgcgcacatctgccgtctgcgcaacaccgcgtccgtcaaggtgctgttggggcgcaagagcgacagcgagcgcggggtggctggcgccgcgcgggtcgtcaataaggcgctgggggaggatgacgagacgaaggccggctcggccgcctcgcgtctcgtgcggctcatcatcaacatgaagggcatgcgccacgtgggcgacatcaacgacacggtacgcgcctacttggacgaggcgggggggcacctgatcgacacccccgccgtcgaccacaccctccctgggttcggcaagggcggcaccggccgcgggtcggcgccccaggacccgggggcgcgaccgcagcagcttcgccaggcgtttcagacggccgtggtcaacaacatcaacggcatgctggagggctatatcaataatctctttggaaccatagaacgcctgcgagagacgaacgcgggtctggcgacccagctgcaggcgcgcgaccgcgagctgcggcgcgcccaggcgggggcgctggagcgggagcagcgcgcggcggaccgggcggccgggggaggcgcgggccgcccggcggaggcggatcttctccgggccgactacgacattatcgacgtcagcaagtccatggacgacgacacgtacgtggccaacagtttccagcaccagtacatccccgcgtacggccaggacctcgagcgcctgtcgcgcctctgggagcacgagctggtgcgctgcttcaagattctgcgccaccgcaacaaccagggccaggaaacgtcgatctcgtactctagcggggcgatcgcctccttcgtggccccgtatttcgagtacgtgcttcgcgccccccgagcgggcgcgctcatcaccggctccgatgtcatcctaggggaggaggagttatgggaggcggtctttaagaaaacccgcctgcagacgtacctgacagacgtcgcggccctgttcgtggcggacgtacagcacgcggctctgccccggcccccctccccaacccccgccgatttccgggcgagcgcgtccccgcggggcgggtcccggtcccggacccggacccgatcccggtcgcccgggagaacgccgaggggtgcgccggaccagggctggggcgtcgaacgcagggatggccgaccccacgcccgccgatgagggaacggccgccgccatcctcaaacaggccatcgccggggaccgcagtctggtcgaggtggcggaggggatcagcaaccaggcgctgctgcgcatggcctgcgaggtgcgccaggtcagcgatcgccagccgcggtttaccgcgaccagcgtcctgcgcgttgacgtcacccccagggggcggttgcggttcgttctggacgggagttccgacgacgcgtacgtggcgtcggaggattactttaagcgctgcggggaccagccgacgtatcgcggttttgcggtcgtcgtcctcacggccaacgaggaccacgtgcacagcctggccgtgccccccctcgttctgctgcaccggctctccttgtttcgccccacggacctccgggacttcgagctcgtctgcctgctgatgtacctggagaactgtccccggagccacgccacgccctcgctgttcgtcaaggtgtcggcgtggttgggggtcgtggcccgccacgcgtctcccttcgagcgcgtccgctgccttctcctccgcagctgccactggatcctgaacacgctaatgtgcatggcgggcgtgaagcccttcgacgacgagctagtcctgccccactggtacatggcccactacctgctggccaacaatccgccccccgtcctctcggccctgttttgcgccaccccgcagagctctgcgttgcagttgcccgggcccgtcccccgcacggactgtgtggcctataacccggccggcgtcatgggaagctgctggaattccaaggacctgcgttcggctctggtgtattggtggctttcggggagccccaaacgacggacctcgtcgcttttctatcggttttgctaactccggaaaataaacgtgttttttatggaacgttccccacctgtcgtgtcatctctcgggggatggtggtgggcctgtgtgtgtgtcttgtgcaccgaaggaggaaagtgggggggtggtggtgctggtggtggaaagacatgatagagggaacaaagaaatagaagaaaaccacaaccggcgcgtgccagtaaatacggacgcgcgcacacgcggggggtaagttggagcacggggccccggtttattgaccaaattcagggaaacagaaaccgcatcttttcctcgaaagggtacacaaagctcccgccctcgccccacacgccttccagaacccccgtaaacaccagttgaatctcgcgcaggatctcgcgcaggtgatgggcgcagtccacgggggggagcaccaagggccgcgggtacagatccacggggacgccgaccgactccccgcccccgggacatacgcgcacgacgcgtctccagtattgctccgcgtccagcagggcgcctccgcggaaggccgtttggggcagggggtcgtcggcctcgcctgggggggtcagaacgctccagtactccgcgtccagacgcctcccgaaggcatccaggacaaagcggtcacaggcgtcctccatgacgccccgggccgcgcacacggcctcctccggcgggccggcggccggccgccggaggattcgtctcagcgcgtcgcgcataacctcggccgccgcggcgtacgcgggcccgcggagaggaaatccctgcaggaagtcggtgtcatcgcgggagttccagaaccacgccccggtctggctccaggtgacgacgtgggtgtagacgccctctggcgccagggagggggcgaggcgcgggcgtatgccgttggccgaaagtacggcgcgcacggacgcctcgagggcccggcgggcgtcctggatcgcgccgtgcgcggcgtccgcgtccccggggtccacgttgaacagcccccagaacgcagccccggtgccgccgcagaccgcaaacttcaccgagctggccgtctgctcgatctgcaggcagacggcggccatgaccccgccgagcagctgccggagcgcggggcaggcgtcgcacgcgtccggcaccaggcgctccagcacggcccgggcccagggctccgagggggcggccgccaccagcgcgtccagcctttccaggcccgcccgcccccgggcttccggcagcccggcctccccgaggcccgcgagggcggccaggagctgggcctggagcccggagaaacaaaaccgcgccgtccagaccggcccgacggccgccggggggtcgagtagttggatggtggtggccgtggggtgccaccgcgccaccgcttcccgaaaggcgggcaggaggcggccggccgcctccgaggccacggccggccatgcccgcgggggcaggacgaccctggcgcccaccgcgggccaggcccccaggcacgcggcatgggtggccgcggcgccccgcaccaggtcacgcgccgactcggcggcggcggcggccggcacggtaaacgtgggccagcccggaaatcccagcacggcaaagtattggacgggccctccccggacctcaaacccgggccccagaaaagcgaagacgggggccagggctccgggggcggcgtggaccgtggtatgccactgccggaagagggcgaccagcgccggggcggagaacccgtcgccggcgctcacgaagtagtcgtagccgcgcggcagcagcacccgcgccgtgacccgctgcgggtgtccgcggggccgcaggccgacctcgcacacctcgaccaggtccgcgaaggcgccctccttcctggtcggcggaaacgccagggtggtgtattcgcgcgcaaaacgcgcggtcctcgtcgtgatggtgacggcgagcgaggcggaggacgcgcactgggggctgtcgcgaatggcggccaggcgcgcccacgccaaccgcgcgccggggtgctcggcgacgcgcgcggacagggccagcgggtcgacgtcgaccttggcctccacgtccaggagggcggcgcgaggagcggccggcgggccccacgacgccctttcgaccctcacgaccagacccgtctgcgggtcccagcccaggcgcagcgggacgaagagggccaccggccccgtctggcgctccagggccgccagaacgcacgcatacagcgcccgccacagggtcgggtcccccaggggctccagcggggaggcggccggggccgtcgcggcgcgggcggccgcgacggccccggcggccgagacgtcgggggagccgtagaagtcctgcaggtcggacgaaccaacggacacctccgcgaagcgcgcgcgcgcctcccccgcggcgtcgcgacagaccagatacagcagggcgtggaggcagtcgcgcgtgcgcgggggcagccataccgcgtatagggtaatggcgctgacgctctcctccacccaaacgatgccgggggcttccatgccacgacgcccgggggttgccgtgtatcgaacgagcgcggccccagacttatagggtgctaaagttcaccgccccctgcatcatgggccaggcctcggtgggaagctccgacagagccgcctcgagaatgatgtcagtgttgggctgggcgccggaggcgtgcgtgcgcaagcagcgcccccacgcgggcgcgcgcagcttgaagcgcgcgcccgcaaactcccgcttatgggccatcagcagcgcgtacagctgtctgtgcgtccggcaggcgctgtggtcgatgcggtgggcgtccagcagctccacgatggctcgcttggtgaggtttttaacgcgccccgccccgggaaacgtctgcgtgctcttggccagctgcaccccgaacagttcgccccagatgatcttgaacagcgacagcgcgtgctccgtctcgctcacggacccgcgcggggggcagccgctcagggcgtcggccacgcgcttaaccgcgtcctccgacagcaaggggccgtcggtcacgttacagtggcccagttcgaacaccagctgcatgtagcggtcgtagtgggggttcagcagctccagcacgtcctcggggctaaaggttcgccccgaccccccggccatcgagtcccactgcaggcacgcggccatggtgctgcacagacggaacagctcccagacgggggcgacgtttagggtggggtgtagggccacaagctccagctctccggcggcgttgatcgtggggatgacgcccgtggcgtagtggtcgtaaagccgccggaagatggcgctgctatgggcggccatggggacgcgaagacaggcctccagcagcaccaggtagatgaaccgcgtgcggccgaccaggctgttgaggccgcgcatgagcgcgaccacctcggccggcgcgacgtccggccggaggtacttttcgacgaaaaggcccacctcctccgtctcggcggcctgggccgacagggacgtgtcggggtcctggcagcgcagctcccgcagatcccgctgggccctcagggcatcaaaatgtatcccccgcaaaaacagacaaaagttcctcggggtcagcgcggcgtcgtggccccagaaccgcacgtgcatgcagttgagggtcagaagcatgtggaggatgttaagactgtccgcgaggcacgccagcgtgcacctctcgaagtagtgcttgtaccggaatttgctgtagatgcgcgacccccgcgcctgcgccgcgtcggcgtgcgacgcgtcgcagcgccctttgaaccggcggcacaacaggttcgtcacctgggaaaactgtgccggccactgcccgctggcgctcaccacgtggttgagcagcatgggcgtaaagacgggctccgagcgcgccccggacccgtccatgtagatcagcagctcccccttgcggagagtccgtacccgccccagcgactggtacacggacaccatgtccggcccgtagttcatgggtttcacgtaggcgaacatgctgtcaaagtgcggcggatcgaagctaaggcccaccgtcacgaccgttgtgtagatgaccacccggtaccggccccatgtggtcacgtcgccgggcggggtgagcgagtggagcagcagcacgcggtccgtaaactgccggcagaacctggcaacgacctccgcgaaggagaccgtcgacgagaagatgcagacgttatctccgccggccaggcgcgcctccagctccccgaagaaggtggcgtccgggggggcgtccggggggggcgccccgcccgccggccccggcgggcgcagggccgcctgcaggacctcgggccccaggcgcgggagaaacagacaacggcgcgccgaaaatccgggcatggcgtactccccgatgaccacgtgaacgttcttttcgccccggaggctgcacagaaagtccaccagctgcgcgttggcggtggcgtccatggcgatgatccgcgggcacgtgcgcagcaggcgcagcatcaacgcgtcgacgcggcccagctgctgcatcgtcggcgagtacagttggcccaacgtcgacatgacttcgtccaggacgagcacgtcgtagttgttcaacaggttcgggcccacgcgatgaagactttccacctgcacgatgagacggtggaaggggcggtcgttcatgatgtaattggtggatgagaagtaggtgacgaagtcgggcaaccctgactcagcgaaccgcgtcgccagggtctgagtaaaactccgacgacaggagacgaccagcacactcgtgtccggagagtggatcgcttcccccaaccagcggatcagcgcggtagtttttcccgagcccattggcgcgcggaccacagttacgcaccgggccgtcggggcgctcgcgtccgggaaggtgacgggtccgtgttgctgccgctcgatcgttgttttcgggtggacccggggaacccactcggccaaatcccccccgtaaagcatccgcgccagcgatacactcgacgtgtactgctcgcactcgtcatccccgatgggacgccgggcccccaggggatcccccgaggccgcgccgggcgccgacgtcgcgcccggggcgcgggcggcgtggtgggtctggtgtgtgcaggtggcgacgttcatcgtctcggccatctgcgtcgtggggctcctggtgctggcctctgtgttccgggacaggtttccctgcctttacgcccccgcgacctcttatgcgaaggcgaacgccacggtcgaggtgcgcgggggtgtagccgtccccctccggttggacacgcagagcctgctggccacgtacgcaattacgtctacgctgttgctggcggcggccgtgtacgccgcggtgggcgcggtgacctcgcgctacgagcgcgcgctggatgcggcccgtcgcctggcggcggcccgtatggcgatgccacacgccacgctaatcgccggaaacgtctgcgcgtggctgttgcagatcacagtcctgctgctggcccaccgcatcagccagctggcccaccttatctacgtcctgcactttgcgtgcctcgtgtatctcgcggcccatttttgcaccaggggggtcctgagcgggacgtacctgcgtcaggttcacggcctgattgacccggcgccgacgcaccatcgtatcgtcggtccggtgcgggcagtaatgacaaacgccttattactgggcaccctcctgtgcacggccgccgccgcggtctcgttgaacacgatcgccgccctgaacttcaacttttccgccccgagcatgctcatctgcctgacgacgctgttcgccctgcttgtcgtgtcgctgttgttggtggtcgagggggtgctgtgtcactacgtgcgcgtgttggtgggcccccacctcggggccatcgccgccaccggcatcgtcggcctggcctgcgagcactaccacaccggtggctactacgtggtggagcagcagtggccgggggcccagacgggagtccgcgtcgccctggcgctcgtcgccgcctttgccctcgccatggccgtgcttcggtgcacgcgcgcctacctgtatcaccggcgacaccacactaaatttttcgtgcgcatgcgcgacacccggcaccgcgcccattcggcgcttcgacgcgtacgcagctccatgcgcggttctaggcgtggcgggccgcccggagacccgggctacgcggaaaccccctacgcgagcgtgtcccaccacgccgagatcgaccggtatggggattccgacggggacccgatctacgacgaagtggcccccgaccacgaggccgagctctacgcccgagtgcaacgccccgggcctgtgcccgacgccgagcccatttacgacaccgtggaggggtatgcgccaaggtccgcgggggagccggtgtacagcaccgttcggcgatggtagccgtttcgttcgttttaataaaccgacgttgtgcgtttcaccatacttcggcgcgcgtgtgtgtgtgtttttttttttgtggtgtttattttccccccaccccttccttttctttcggccaccacccccctcctcccccgtactatacaacaaaaaataccacacatacgaccaaatacggacaatcatttctgtctttattcgctatcagagagtgggggcgtgagcgtggcaggagggcgggccacgtcggggtcccgccgtctggtgtgacgcgatggggggtccgatgcgcgccggtactggggccccggcgcccgggtgaccacgcgcacgtcggggggcacgtagaagttaccctcttcttcggactcgatgtccacgacgtcaaattcgtgggcggtcagcgagacgacctccccgccgtcggtggtgatgacgttgtgtcggcagcagcagggccgcgccccggagaacgcgaggcccataacttggcgagcgtatcgtcgaaggccaggcggctgtttcgccggatgtcccggtagatccccggctcgacgcggacgggggtgatgatcagggcgatcggaacggcctggtccgggaggatcgatgccttggcgggtccgggggccccgccacgcccggcgggcgctccgcggccgtcctccaggcggaacgtcacgccctcctccgcgcccgcgcggtgcctgccgaggaacgtcaccaggtgcggttgcagggggcagtcgggaaagtggctgtcgaggacgtatccctgcaccaagatctgtttgaagttcgggtggcgggggttggcgaagatgggctcgcggcgaaccagctccccggagctccaggccacgggagagatggtgcgacgctcaaggtcggggacgccaaacagaagcacctccgagacaacgccgctatttaactccaccagcgcccgatccggggcggagcatcgccttttttcgccggcggcgcgggaatcgagccagtcccggtcttgggtgacgagcgcctcctccgggcccggaacgcgcccgggcgcgaagtagcgcacgccggggttggggatggaccggatgaacgcccggaacgcctccggcgatcgccgcgccatcaggtcctcgtacgcggaggccgcgggggcgccggggtccgcggggtcgaacgcgtacttggctcggcacttaacctcgtagaaggccaggggggtctggggggcgggggccaggtagccgtgagggtccctggggcacacgaggatgtccagggacgcccccaccatgcccgtgtggccgtccatgaggaccccgcacgcgtgcacgttctcctcggcgaggtccccgggttggtgaaagacgaagcgcccggcgtcggcgtcgtcgttgacgcccgcgtccgcgcggcccacgcagtagcgaaacagcaggtttcgggccgtcggctcgttcacccgcccgaacatcaccgccgacgactgggcgtccagccgcaggctggcgttgtgggtgagccactgggacgagaagcacggaccctgcgcgccccaccgcagcgtggaggcggtcgtcaggccccgccgaagcagggcccagagctggcagtcggcctggttttgcgtcgccgcctcgtaaaatcccataagcgggcggggggcgacggcttcggcggcggacgggggggcgcggcgcgtcaggcgccagaggtgccggccgagcccgcggtccaccatgccggccgcctccagcgacacgacgagggagcacagatagtccaggcgagcccacaggggcccgatggccagaggggagcggacgccgcgcagcaggccgcgcaggtggcgctcgaacgtttccgccaagatatgggggggcagtgcgttggggatcgccgacgccgaccacatcgggtcggggtccgggggaccggggctgcagtccgggtcgatggcgtgtgcgccccccggcgagaggggaatgtcgggggttggcgggccggatgaggcctcagagagggccggggacgcgggccgggccttttcgcccggggccccgccgtcgggttgcccacgtggggggctctggggccaatgggaacccggggcccccggtgacgtggggcggggtggggcggggcggggcccaaagacggtcgccagatctaggctgttgggtcggggccgcttcgggggactatcggggtcgcgggcggggtccgcggggcgcttggcgccgggtgttgcggcggccgccatttttacgagcagccgaagagctcgagggcggaagggatcctcacgacagagagtggcgcgcggccgggttggcgtgacagaggcgggagaccagcaccagcagcggcctcagctcgggcggcagcgacaccgacgacaggacggccttgtgcgtgcgctggtaatttatacactgctccgtgaacgcgcgccgaatcttgggattgcgaaggtggcgccggatgccctccggcacgtcatacgccaggccgtgggtgttggtctcggccgagttgacaaagagggcggggtgcagaacgcagcgataggcgaggagggccacggcaaagtccggcgagagctggttgttaaagtactggtagcccgggacgcgggtcacggggacgcccaggctcggggccacgtacacgctaaccagcagctccagcagcgtctgccccagggcgtagagatcgaccgccagcccgacgtcgtgcttcagggggcggttgttaaactcggcccgctcgttgttgaggtactttaccgagagctccggtggctggttgtacccgtgccccaccagagtgtgaaagttggccgtggtcagggcggcgggcatcccaaacccccggggggactcgaggtccggctcctggaggcaaaactggccccgggatatcgtggagttggagttcagggtcaccaggctaaagtcggccaggacggcccgccggagcgacaccgcgtccgatcgcagcatcacgaggacgttggcgcacttgatgtccaggtggctgatcccgcacctggtgttcaggaacaccacggcgcgcgccaggtctgtgaagcagtggtggagggccgtcgcgacggagggggtggtcgcgcgcagggacgccagctggccgatgtacttgccgaggtccatgtcgtacgcggggaacacgatctggcgctgctgcagcgagaacccgagcggggtgataaagccgcggatgtcgtgggtgcggccgccgcgaagagcgcactcccccacgagcagggtcgcgacgagctccacggcaaaccactctttttcccggatggtcttcacggcgagcttgtgttcgcgaatcaactgcacctcgccgtacccccccgagcccccgaagctgcgggccccggggatctccagggtcgtgtagcggagggcggggttgacggcgaatacggggatgcatagcttgtggatgcgcgcgagggacaggatgtgcgaggggggcgacgggggcgaggtcatggccgtctcggacctgcgcaggggcgggcgccttagcttggccgcagggccgggggcctcgggggacgagcggcgacgagacgagcggctcactcgccatcgggacagtcccgcgcgaagccgctcccggaagctggatcggcggcgggacccggggcgggctccggagacggcgccgtctcggggggaggggccgcttgggcgtccggacgcccggcggctgagggagtgtatgtaggacgcgagccaggccttgaaggagcgtcggtgtgcaccttgggggctgatgtcagctgccacatgactagcaggtcgctgtcgcccggactcatccatccgtccgccaggtcgccgtccccccacagagacgcgttcgccgcggcctcttcgagctgctcctcctggtccgcaagacgatcgtccgccgcgtccaggcgctcgctaagcgcgggatcgaggtaccgtcggtgtgcggttagaaaatcacgtcgcgccgcttgctcttccacgcgaattttaacacaggtcgctcgctgtcgcatcatctctaagcgcgcgcgggactttagccgcgcctccaattccaagtgggccgccttggcggccataaaggcgccaacaaacctaggatcttgtgtactcacgccctcccggtgtagctgcagggtctggtccctgtacacctcggcccggaggtgcgtctcggccaaacgtcggcgcagggccgcgtggctggcgtctcggctcatctcgccgcccccgcgcgcgcccgacgtcggactccttcgccccgacccccctgacctcagccgcccccgcctcgcccgcgatgtttggccagcagctggcgtccgacgtgcagcagtacctggagcgcctggagaaacagaggcaacagaaggtgggcgtcgacgaggcgtcggcgggcctgacgctcggcggcgatgcgctgcgcgtcccttttttggattttgccaccgcgacgcccaagcgccaccagaccgtggtcccgggcgtcgggacgctccacgactgctgcgagcactcgccgctcttctcggccgtcgcgcggcggttgctgtttaatagcctggtgccggcgcaactcagggggcgtgactttgggggcgaccacacggccaagctggagttcctggcccccgagctggtgcgggcggtggcgcgcctgcggtttcgggagtgcgcgccggaggacgccgtgccccaacgcaacgcctactacagcgtcctgaacacgtttcaggccctgcaccgctccgaagcctttcggcagttggttcacttcgtgcgggacttcgcccagttgttgaaaacctcgttccgggcctctagtctcgcggagactacgggccccccgaagaaacgggccaaggtggacgtggccacccacgggcagacgtacggcaccttggagctcttccagaaaatgatactaatgcacgcgacctactttctggccgccgtgctgctcggggaccacgcggagcaggtcaacacgttcctgcggctcgtgttcgagatccccctgtttagcgacacggccgtgcggcacttccgccagcgcgccaccgtgtttctagtccccaggcgccacggaaagacctggtttttggtgcccctcatcgcgctgtcgctcgcgtccttccgggggatcaagataggctacacggcccacatccgcaaggcgaccgagcccgtgtttgatgagatcgacgcctgcctgcggggctggtttggctcgtcccgggtggaccacgtcaagggggaaaccatctcgttctcgttcccggacggctcgcgcagcacgatcgtgtttgcctccagccacaacacgaacgtaagtacgccttcctcccgcggtgcctgtttccccggtgccgccctccccgagatcgaccgacagacaaacacagccagacgcgagtgtgggacgacacgcccgcagccccccccccgccatggcgggggggaagccttactgtttatttgtaatcggacgatgaggctctggccacggcccgcgcgaccgcggggcagctcgttgcaaacaggcggctggtatacgatgacagaacgcagaggcgccacccggcgctggtcgggcggatgacgctttccgcgccgtcccggcccacgacgacctcgtgcaggtgggccgtgatgcgcgggcggcgggtcgcctgccgcaggataaccgcgtccacggggtgcccgaagaggagctgacacaggctcgcgtccccccggacggccagggtgcgctgggccatattggaccacatgcacggggcgacgcagggacaggcctccgccacggcgggggcgcgccacagcgcgttggcggaatcgatgtgggccgtcggggcgcaggcgccgcctcctcccggggggtcggtaatcctggatagcagccatcctaaatggcgggcccggctgcccgggggacagagcgaccccaggtcatcatccatggcccagcagtatatgcggccgccggggaggtgccaccaggcccccggacccagggcacagcacgcccccggattcgggggcggttccgtgggtaccaggtaggcgccgtcgagctcgtgggccacgggctcgtccgcgagctgttcggcggcggggtcgggggtttcctccgggggggaggcagcttccaggtggccgaaggctagggtgcacagcagcggggtccgggggtgcgttacgctgcggaggtggacggtggcgcagtagcggcgctcgcggttaaagaagaaaatggcaaagaacgtgttcgaaggcaggcgcagcgccttgggccgcgtcaggtacaggaagatctcgcagaaaagggcacgctcggggtcggggtccggaagggccacctggcacagcggctcggtgaggaccgtgaggcaccgaaaaatcttaagccgctcgtccccccgaacgacgcgccacacgaagacagagttggcgatgcgcgcgacgaggtcggcttcgggccccgggtcgggggcgcgcgcgtcggggggggcgccccggtgacccggcggggccgcggctcccggggggcctggcgtcgcctggggacgccagagtgcccgctgtgccaggttggtggtggggaagggaccggagacgcaccaaaagcagaggggccagcgcgtgtatgagttggggggggggtgggtgagcggtggaacaaaagcacgcgtcagcggacaaggccgggtcccgtagccgccccgcgacagaaccggagtccgacggcacgcgcgacggggtctgcgaggctgaggtacgccgcggtgttaatggtaaacgcaaagcctcccggaaagaccactagcccgcagaggcggcgattgaacccaaggcagaggtacgcgtagctctctcccggaaggtattgctcgcagaccctgtgtggggcagtggaggggctgccctccatgaagcgacatttactctgctcgcgtccattgacgtcaccgtcaatcaccactgcgattggacggttggtgaggcgcagcgtgtctccgctggtgctgtagtagtcaaacgcgtagtgggcgtcggagtcggcgaagcgggcggggatgtcgtcgctgagagggacgagccgccgccgccgcccccgaccgccctggccgcccagatgcgccagcacggccagggcgtacgcggtgtgaaagaacgcgtcgggggcggtcccctcgagggcgcgcatcaggttctccaggagcacggggaagcgccgcgtcacctcccctagccactcgctctggtgggggccaaagtcgtagcgcaggcgctggaagatgcgcgggccgccttggagcgcggcccggatagagtggcccagggcccgcagacacgcgatctggatgcgcgcgacgaaggccacctcggccgcgatgtcaaagggctgcagcacggggcgcgggtggcgcaggggtccctcgagcgcgggaaagcgacgcagcagcgccgtctgggccgcgggggacagctggtgggggcgcacgacgcgctcggcggcacaggcctccgtcagggccgtggccagctcggaggacagccgcggggggcgggcgcgtcgcccgccccacgccaccgaattctcgtaggagacgacgacgaagcgctgcttggtcccgtagtgatggcgcaggaccacggagatggagcgacggctccacagccagtcgggccggtcgccgccggccagagcttcccacccgcggtccagccactcgaccagcgatcgcggcttggcggtccccggcacgagggtgagcacgtcgttgaggacgtcctcgcccgcggcccgggggccccccggggtggcaaagcgccccccgccgggcggctccaggcccgccagcaccgcctccgcgtccgacgcgcccagggctcccccgctgacggcctggtggaccagggcgccctggcggagccccgaggcgacgccggaggccgcgtgcttggggcgcgcgcggaccgggtggcggcgggtgacgtcctgcacggcccgctggaccagcgcgaggatctcctcgttctcttgcgtgatggacacgtcctccgcggtggccgtgtcgcctcccggggccgtgagctgctcctccggggagatgggggggtctggggtgccgacaacggccggcccggccccgcccgagaccgaggacgcctggggagtgggggtgccgctttcccccatccccagggacaggtgggccgccgcctccgtcgcggcggcgggagccgcggcccccagccgcgcgacgtagcgacaaaagtggcgacagaggcgcatgaggcgcgcgccgtcggccgcgtatcgcgtgtttggcgggacgagctcgtcgtaactgaacaggagcacgcgggcgcaggtcgcccacgggccccacgccaggcgcagcgccgcgaccgtgtacgggtcgtacacgccttgggcgtcgcacgcgaccggcagggagacgaacagcccgcccgcgctggggacgcgcggcaggaggtccgggtgcgccgggatgacgggggctaggatcgcccccaccgcatccgccggcacgtaggcggcaaacgccgaacgccacggggtgcagtcgccggtcgcgtgggcccgggtctgggtttcgacccggaagttcgcggccgccccaccgtcggggcggccgcgcacgagggcggacagcgggacccccgccgccgccaggcactcgctggagatgatgacgtgaatcagcgaggcggggctgctcgggtcccgggtgagatcgtattggacctcgttggcaaagtgcgcgttcatggcccggccggcggtgcgagcccttcccggtgccggaaggggcgtgggtggggggtgcgtgtgcgcgtcctcggggcccgcgggcgcacgtgcgcttatacgctgtgtgtttcgtctgtccccagggaatccggggccaggactttaacctgcttttcgtcgacgaggccaactttattcgcccggatgcggtccagacgattatgggctttctcaatcaggccaactgcaagatcatcttcgtctcgtcgaccaacaccgggaaggccagcacgagctttttgtacaacctccgcggggccgccgacgagctgctcaacgtggtcacctatatatgcgacgaccacatgccgcgggtggtgacgcacaccaacgccacggcctgttcctgctatatcctgaacaaacccgtgtttatcacgatggacggcgccgttcgccggacggccgatctgtttctgcccgactccttcatgcaggagatcatcggggggcaggcccgcgagaccggcgacgaccggcccgtcctaacaaagtcggcgggggagcggtttctgctgtaccgcccctccaccaccaccaacagcggcctgatggcccccgagctgtacgtgtacgtggacccggcgttcacggccaacacgcgcgcctccggcaccggcatcgcggtcgtcgggaggtaccgcgacgatttcattatcttcgccctggagcactttttcctccgcgcgctcacgggatcggcccccgcggacatcgcccgctgcgtcgtgcacagcctcgcccaggtgctggcgctgcaccccggggcgtttcgcagcgttcgcgtggcggtcgagggcaacagcagccaggactcggccgtggccatcgccacacacgtgcataccgagatgcaccgcatcctggcctcggcgggggccaacggcccggggcccgagctcctcttctatcactgcgagccgcccggcggcgcggtattgtaccccttctttctgctcaacaaacagaagacgcccgccttcgaatactttatcaaaaagttcaactccgggggcgtcatggcgtcccaggagctcgtctccgtgacggtgcgcctgcagaccgacccggtcgagtatctgtccgagcagctcaacaacctcatcgaaaccgtctctcccaacaccgacgtccgcatgtactccggaaaacgcaacggtgccgcggacgacctcatggtcgcggtcatcatggccatttacctggcggccccgaccgggatccccccggccttttttccgatcacgcgcacgtcttgagtctttcttgccgtttcttttgtttctctttctttccccccctctctccgcaataaacgccttcccggaactgtgtttccccccctacaacagtgttgtccgttggttgggtggttggggtgcgggggtgggcgggggaagcaagaaaacggtcggcgaacacaacatcgggaaaacggattcccgcacgtgcgtcttcccagattcgacacacacaccccccttctccttaaataaacacaaaccacacgctcgttggttggttaatgccagcgctttatttacgtcttgttttttttgcgtttcctccgcgggtcccttcccaacacgcctgcccccgcctcaggggtagcggataaccggggccatgtcgccggattgcacaacggcggcgccgtcgaacgtacacacccgaaccgccggggccagggccaggatgtccccgagttggcccgcgtgcgccagccaggcgaccagcgcctcgtaaagcggcagcctgcgttcgccgtcctgcatcagcatgggggcttcggggtggatgagctgggcggcttctcgcgtgacgctctgcatctgcaggagcgcgttcacgtatccgtcctgggcgctcagcgcgagcagccgggggatgagcgtgaggatgagggtggttccttcggttatggagtagaccatgttgaggacgagcgaccgcagctcggtgtttacggaggcgagttgctggacgtcggccacgagcgagagacgggccccgttgtaatacagcacgttgaggtcggggagctccccgggcgtccgggggtcggggttgaggtcccggatgccccgggcgaccagccgcgcgactatctcgcgggccaggggcgttgggagcgggaccggaaaccgcagcgtgaggtccagcgactccaggcgcacgtccgtcgcctggccctcgaagacgggcgggacgaggctgacgggatccccgttgcagaggtcgacgggggaggtgttgcggagattgacggtgccggcgtgcgtgagccccaggtccacggggcaggcgacgattcgcgtgggcagcacccgcgtgattaccgcggggaagcgcctgcggtacgccagcaacaaccccaacgtgtcgggactaactcctccggagacgaacgattcgtgcgccacgtccgcgagcgccagctggcggcggatggtcggcagaaagaccactcgaccctcgcaccgctgcagcgccgcggcatcggggcgcgagatacccgaggggatcgcgatgtctgcttcgaaacaatccgtgatcatggcgccgggccgcgagacaccggaacgcgggggtgcgggagggccggaaagcgcaacgcaaccgggacgatgatgaaacagagatggggggcaccgaccgtgtgggagagggggcggggcagggctcagcagcacgcacggggaggtctgtcgtgcgcaggagccccaggtgagaatcagtcccccggagctcgggtctgggttttattgggacctgccctcggaatcgcggctcccagtccaagcccccctggggggggcggggacagggggtgtgtgtgggtaaaagcaacgtcggaaaatcaaacccaatgccccaaacaggaaaaaaaaagacgggcgggtggagggaaagctggggaagaagaagccaattttacagagacaggccctttagcggggaggcgtcgtagatgagatactgcgtaaagtgggtctctcgcgcgtgggcctccccatcgcgggcgctgcgtagcagggcggggtcgctggcgcaggtgatcgggtaggcttcctgaaacaggccgcacgggtcttccacgagctcgcggcaccccggcgggcgcttaaactgcacgtcgctggcagcggtggccgtggataccgccgatcccgtttccacgataagacgctccaggcagcgatgtttggccgtgatgtcggccgcggtgaagaacttgaagcaggggctgaggacgggcgaggccccgttgaggtgataggccccgttgtacagcaggtccccgtacgagaaccgctgcgacgcccacgggttggccgtggccgcgaagggccgcgccgggtcgctctggccgtggtcgtacatgagggctatgacgtccccctccttgtcccccgcgtacacgccgccggccgcgcgtccccgcgggttgcagggccggcgaaagtagttgatgtccgtggccacgggggtggcgatgaactcacacacggcatcctgcccgtggtccatgccggcgcgccgcggcacctgggcgcagccaaagaccgggaggggctgggccggccccagccggtttcccgccacgaccgcgttgcgcaggtacacggcggccgcgttgtctagcagcgggggggccccgcggccgaggtaaaagttttgggggaggttgcccatgtccgtaacggggttgcggacggtggccgtggccgcgacggcggtgtagcccacacccaggtccacgtttccgcgcggctgggtgagcgtgaagttgacccccccgcccgtttcgtggcgggccacctggagctggcccagaaagtacgcctccgacgcgcgctcggaaaacagcacgttctcggtcacgaagcggtcctgccgcacgacggtgaacccgaacccggggtggaggcccgtcttgagctggtgatacagggccacggggctcatcttgaagtaccccgccatgagcgcgtaggtcagcgcgttctcccccgccgcgctctcgcgggcgtgctgcaccacgggctggcggatggaggagaagtagttggcccccagggccggggggaccagggggacgtggcgcgccaggtcgcgcagggccggggggaagttgggcgcgttggccacgtggtcggcgcccgcaaacagcgcgtggacgggcaggacgtagaagtattcgccattttggatggtgtggtccaggtgctggggggccatgagcagcacgccggcgtgcagcgccccgtcgaagatgcgcatgttggccgtcgacgcggtgttggcgcccgcgtcgggcgccgcggagcacagcagcgccgtcgtgcgctcggccatgttgtgcgccagcacctgcagcgtgagcatggcgggcccgtcgacgacgacgcgcccgttgtggaacatggcgttgaccgtgttggccaccagattggcgggatgcagcgggtgggcggggtcggtcacgggatcgctcgggcactcctcaccgggggcgatctccgggaccaccatgttctgcagcgtggcgtacacgcggtcgaagcggacccccgcggtgcagcagcgcccccgcgagaaggccggcaccagcacgtaatagtagattttgtggtggacggtccagtcggccggccggtgcggccggtcgtcggcggcgtcggccgcgcgggcctgggtgttgtgcagcagccggccgtcgttgcggttaaagtcggccgtcgccacgttgcacgccgccgcgtagacgggctcgtgcccccccgcgtcaatccggcagtctcggtggcggtccagggccgcgtgtcgcataaggccgtcgcagtcccacacgaggggcggcagcagcgccgggtcgcgcatcaggtgattcagctcggcctgagcctgcccgcccagctccgggcccggcagggtaaagtcgtccaccagctgggccagggcctcgacgtgggccaccaggtcccgatacacggccatgcactcctcggggaggtcgcccccgaggtaggtcacgatgtacgagaccagcgagtagtcgttcacgaacgccgcgcatcgcgtgttgttccagtagctggtgatgcactgagtcacgagccgcgccagggcgcagaacacgtgctcgctgccgtgaatcgcggcttgcagcaggtaaaacaccgccgggtagctgcggtcctcgaacgccccgcggacggcggctatggtagccggcgccatggcgtggcggccaacgccgagctccaggccccgggcgtcacgaaacgccaccggacacagcgccaggggcaggttgccgttgaccacgcgccaggtggcctggatcgcccccggaccggccggggggacttcgccgccgggaagctcgacgtcggccacgcccgcgaagaagtcgaacgcggggtgcagctccagagccaggttggcgttgtcgggctgcatgaactgctccgcggtcatctggcactcggcgacccaccggacccggccgtgggcgaggcgctgccgccaggcgttcagaaaacgctgctgcatgtccgcgccggggccggccggggccgcgacgtacgccccgtacggattcgcggcctcgacggggtcgtggttcacgcccccgacggccgcgtcgatgttcatgagcgaaggatgacacacggtcccgaccgcgttctccatggacagccgcagaacctggtggtcctttccccaaaaaaacagctgccggggagggaacgcgcggggctccgggtggccgggggcgggcaccaggtccccggcgtgcgcggcgaagcgctccatggccgggttgaacagccccaggggcaggacgaacgtcaggtccatggcgcccaccagggggtagggcacgttggtggcggcgtagatgcgcttctccagggcctccaggaagaccagcctgtcgcctatggccaccagatccgcgcgcacgcgcgttgtctggggggcgctttcgagttcatccagcgtctcccggttcgcctcgagttgctcctcctgcatatccagcaggtggcggcccacgtcgtccaggctccgcacggccttgcccatcaccagcgccgtgacgaggttggccccgttcaagaccatctcgccgtaggtcaccggcacgtcggcctcggtgtcctccaccttcaggaaggactgcaggaggcgctgtttgatggcggcggtggtgaccagcaccccgtcgaccggccgcccgcgcgtgtcggcgtgcgtcaggcggggcacggccacggacggctgcgtcgccgtggtcaggtccacgagccaggcctcgatggcctcgcggcgatggcccgccttgcccaggaagaagctcgtgtcgcaaaagctccgcttcagctcggcgaccagggtcgcccgggcaaccctggtcgccaggcgcccgttgtcgagatatcgttgcatgggcaacagcagggccaggggaggcgccttctccaacagcacgtgcagcatctggtcggccgtgccgcgctcaaacgcccccaggacggcctggacgttgcgcgcgagctgctggatggcgcgcagctggcgatgcaggctaatgcccgtcccgtccagggcctcccccgtgagcagggcaatggcctcggtggccaggctgaaggcggcgttcagggcccggcggtcgatgaccttcgtcatgtaattatgcacgggctgctcgacggggtgcgggccgtcgcgggcgatgaggggctggtggacctcgaactgcacacgcccttcgttcatgtaagccagctccgggaacttggtgcacacgcacgccacggacaggccgagctccagaaagcgcacgagcgacagggtgttgcagtaggaccccagcagggcgtcaaactctacgtcatacaggctgttttcgtcggagcgcacgcgggcgaaaaaatcaaagagtctgcggtgggacgccacctcgatcgtactcaggatggagccggtgggcaccatggccgcggcgtaccggtaacccggggggtcgcgggcaggagcggccattgggttccttgggggattcgcaggctccatcaagccgagctcgggaaggccaagcccctcccgcacaacgcctcaccgccggcggacgcgactaacaacccacgggccgccaaaaccccaaggggcaacccgaccaacaacaggcgaggggaggaaaggcgtaaagggggcgttgggaggcaaaaagaaagaaaacacccagacgtaggcccgaggaccggccggcgtcctctgtccccgagcacccactgtgcccaacaggcacgggggcgagctgcccctgccttatatacccccccgccacacccccgttagaacgcgacgggtgccttcaagatggccctggtccaaaagcgtgctagaaaaaagttggtaaaggcggcaaagcagtccgccgccgccacccacatggcggcgccggccgcgcaggcgattcccagagaacgggcgcggaggggatccgtgcggggcagcagctggctggcggtgatccaatggaaaagcccgtcgggactgaacgtctcatgggcggccgccaccagggcgcacagggccgcgccgcccatgatcacgcacaacccccaaaacacgggtggcgacaacggcaggcgatcccgtttgatgttcacgtacaggaggagcgcccgtgccagccacgtgacatagtaggcgaggacggcggctataatacatgccggcgccaccgcccgtccggtccacccgtaatacatgcccgcggccaccagctccagcggcttgaggaccaggaacgaccaagcaaacatcaccacccgcttggaaaagaccggctgggtgtggggcggaagacgcgagtaggccgaactgacaaaaaaatcagacgtgccgtacgaggacagcgaaaactgttcatcgagcggcagttctccgtcctccccgccacacgcggcctcgtctaccagctcgcgatccaacaaaggaacatcatcccgcattgtcatggtcggtgcggggagccggcgaggcagcaaaaccgaaagtagtgctggcggcgcgggcccgggtccggacccaagcttcagggatggggggcggaggccaaaatcaaacaagcaccgcgcgggttctacacacaacccccacccgggtagtatccgcggatgcgagtgcctggcgaagtcacgtcccagcaggatataaacctcggccgttgggcccggaacccccgaaattcacacccacgccctgacgcccaaatcatgggtggatgtggttcgcgagccgcacatccgtgcgtccgccctcccccgcgggctgatgacgtggcggttagtcagtgggaaggcagggggaaagatgggttgggggaggaaacgaagaaaacacccagagggccacgtcgggaatgcgcccggagttgtccttaaaaggccggccgtgcgtgacggaagccgtcgtttgcccaagcaccgacgccgcgatccacagtggggggagttcctccgtccggccacaaccctacgcgcgggcggcacgcgcgagagcaacccacgggtcccgttcgcgccaccgccagcccttgctcccaccaccctcctcccaccaccccactattcccccccccaagtccgccccgtggctcgccggccatggagctcagctatgccaccaccctgcaccaccgggacgttgtgttttacgtcacggcagacagaaaccgcgcctactttgtgtgcggggggtccgtttattccgtagggcggcctcgggattctcagccgggggaaattgccaagtttggcctggtggtccgggggacaggccccaaagaccgcatggtcgccaactacgtacgaagcgagctccgccagcgcggcctgcgggacgtgcggcccgtgggggaggacgaggtgttcctggacagcgtgtgtctgctaaacccgaacgtgagctccgagcgagacgtgattaataccaacgacgttgaagtgctggacgaatgcctggccgaatactgcacctcgctgcgaaccagcccgggggtgctggtgaccggggtgcgcgtgcgcgcgcgagacagggtcatcgagctatttgagcacccggcgatcgtcaacatttcctcgcgcttcgcgtacaccccctccccctacgtattcgccctggcccaggcgcacctcccccggctcccgagctcgctggagcccctggtgagcggcctgtttgacggcattcccgccccgcgccagcccctggacgcccgcgaccggcgcacggatgtcgtgatcacgggcacccgcgcccccagaccgatggccgggaccggggccgggggcgcgggggccaagcgggccaccgtcagcgagttcgtgcaagtgaagcacatcgaccgtgttgtgtccccgagcgtctcttccgcccccccgccgagcgcccccgacgcgagtctgccgcccccggggctccaggaggccgccccgccgggccccccgctcagggagctgtggtgggtgttctacgccggcgaccgggcgctggaggagccccacgccgagtcgggattgacgcgcgaggaggtccgcgccgtgcatgggttccgggagcaggcgtggaagctgtttgggtcggtgggggctccgcgggcgtttctcggggccgcgctggccctgagcccgacccaaaagctcgccgtctactactatctcatccaccgggagcggcgcatgtcccccttccccgcgctcgtgcggctcgtcggtcggtacatccagcgccacggcctgtacgttcccgcgcccgacgaaccgacgttggccgatgccatgaacgggctgttccgcgacgcgctggcggccgggaccgtggccgagcagctcctcatgttcgacctcctcccgcccaaggacgtgccggtggggagcgacgcgcgggccgacagcgccgccctgctgcgctttgtggactcgcaacgcctgaccccgggggggtccgtctcgcccgagcacgtcatgtacctcggcgcgttcctgggcgtgttgtacgccggccacggacgcctggccgcggccacgcataccgcgcgcctgacgggcgtgacgtccctggtcctgaccgtgggggacgtcgaccggatgtccgcgtttgaccgcgggccggcgggggcggctggccgcacgcgaaccgccgggtacctggacgcgctgcttaccgtttgcctggctcgcgcccagcacggccagtctgtgtgagatatcccaataaagtgcagtcgttttctaacccacggatgccgttgtatgcctatacgggggactatggggggggaaaggaaaggaaacaggaatggagaagggaaaggaacagaggcggtagcggacgcacggcggacacaataacaaacagaccgcggacacggagggagtcggttgggttgggcgtggacgccgctgcgtccacacacccgtttattcgcgtctccacaaaaatgggacgcacgttcggaccaccctaaggatgcccgccagggccgcggtaatcataacgacccccagcgcggacgcggccagaaacccgggggcgatggtggcgatgggcagcgtgtcaaaggccagcagatgaatcacagttccgttggggaacaacaacagggccacggacggcacgtcgctggaaaacacgttcggggtgcccgccaccggcccctgggccagctgctgttgggtggcatccgtgtccaccagcagcaccgacatgacctccccggccggggtgtagcgcagaaacacggcccccacgaggccgaggtcgcgccggttttcggtgcgcaccagccgcttcggctcaatctcccgcgcgtgcccttcgcaggtggcggtgagataggtgataaacagcgggcggcggacgtcaacgcccgtaagcttgtatccgatcccgcggggcaagggggtgtgggtgacgacgtagctggcgttgtgggtgatgggcacgaggatccggggctccgcgttgtgcgacgggccgctacactggtgggtggcctccgggacgaaggcgcggatcagggcgttgtagtgcgcccagcgcgtgagaacggaggccacgccgcgggtctgttgtgccatgacgtccgccgggatgtcggatcgggtggccatggccagcgcgtccaggatgaacccgccctcggcgagatcgaagcgcagggaagctgcgcatggggaaaagtggtccgggagccagaagaggtttttctggtggtcggtcctggctagcgcggcccggagatcggcgtgggtcgccgcggcgacgtcggacgtacacagggccgtggttatgaggaggccccggcgggcgcgttcccgctgctcggccgagggcgcgcccgccaggaacggcgcccggaggacggccgtggcgtaaaacagcgctcggcggaccatcggggcggttagcgcgcggccgccgagaaactcggcgtacagggcgtcgatcaggcgggccgcgctcggggccaccgcgccataggccgcggggctgtccaacacgaacgccagctgatagcccagcgcgtgcgccgccaggctctgctctcgctcgaggatcgcggccaccagatgcccgaggcgcgcctccagccgcaggcgggccgccgggtccaacacggacacgttcaggaacaccgagtcggccgcgcagcccgctgctccccgggcggccaggccggccagcacgcgcgagtgggccaaaaagcccagcaggtcggagaggcgaatcgcgtcgtgggcgtgggccgcgttgacgaacgcaaaccccgacgaggcgagcagccccgcgaggcgccagaacagggacggacgcgcgtccgtgccggagcccgggtcctcccccaaaaactccgcataggcccgcgacatatactgggcgtagttcgtgctctcctcggggtagccggccacccgccggagggcgtccagcgccgagccgttgtcggcgggcgtcggggcccccaggacaaagacgcgatacctggggccggccggaggcccggggagcaccgcgggggcgttttcgtcggtcggatttccgacccgagcgagggtcttgtccgcaggcaccactatgatctcggccggagggctgtcccgcatcgatatcacgagccccatgaagcccttcccgtatcgcgcgcgcacgagcgcggcgtcgcacccgaacgccagcccgcccgtcgtccagacgcccacgggccacgtcgaggccgacggggagaggtacacgtaccgacccggagtccgtagcaggcccctggcggccagccaggtcacggatgcgttgtgcagatgcgcgatgctcaggttcgtcgtcggatgcctcggtgtccccgcgggcggccccgggggcggcgcgttgcgtcggccgtccgggtgcctctcggtcgccccgtcgtctccccgcgggaacgtaagcccctcgcggtccggcgcggccgcgaatgttacccaggcccgggaccgcaacagcgcggaggcgccggggttgtgcgacagtcccttgagctgggtcacctcggcggggggacgggacgtgggccccgcctcggggagctcgggcaggctcgcgttccgaggccggccgagcagataggtctttgggatgtaaagcagctgcccggggtcccgaggaaactcggccgtggtgaccaacacgaaacaaaagcgctcggcgtaccaccgaagcatgggcacggatgccgtagtcaggttgagttcgcccgggggcgccaagcgtccgcgctgggggtcgctggcgtcgggggtgttgggcaaccacagacgcccggtgtttgtgtcgcgccagtacgtgcgggccaaccccagaccgtgcaaaaaccacgggtcgatttgctccgtccagtacgtgtcatggcccccggcaacgcccaccaggacccccatcaccacccacagaccggggcccatggtcgtccgtcccggctgccagtccgcagatgggggggggtgtccgtacccacggcccaaagaggctccgcacctcggaggctatcggaggccctttgttgccgtaagcgcgggccaaaggatggggtggggtgagggtaaaagcacaaagggagtaccagaccgaaaacaaggacggatcggcccgctccgtttttcggtggggtgctgatacggtgccagccctggccccgaacccccgcgcttatggacacaccacacgacaacaatgccttttattctgttcttttattgccgtcatcgccgggaggccttccgttcgggcttccgtgtttgaactaaactccccccacctcgcgggcaaacgtgcgcgccaggtcgcgtatctcggcgatggacccggcggttgtgacgcgggttgggatcatcccggcggtgaggcgcaacagggcgtctcgacacccgacgggcgactgatcgtaatccaggacaaatagatgcatcggaaggaggcggtcggccaagacgtccaagacccaggcaaaaatgtggtacaagtccccgttgggggccagcagctcgggaacgcggaacagggcaaacagcgtgtcctcgatgcggggcagagaccccgcgccgtcctcggggtcggggcgcggggtcgccgcggcgacccccgtcagccggccccagtcctcccgccacctcccgccgcgctgcaggtaccgcaccgtgttggcgagtagatcgtagacacggcgaatggcggacagcatggccaggtcaagccgctcgcccgggcgttggcgtctggccaggcggtcggcgtgttcggcctccggaaggacacccaggaccaggttcgtgccgggcgcggtcgggggcatgagggccacgaacgccaacacggcctggggggtcatgcttcccatgaggtaccgcgcggccgggtagcacagcagggaggcgatagggtgccggtcgaaaacaagggtgagggccgggggcggggcttgcgggcccacagcctcccccccgatatgaggagccaaaacggcgtccgtcgccgcataaggcgtgctcattgttatctgggcgctggtcattaccaccgccgcctccccggccgatatctcgccgcggtccagacggtgctgcgtgttgtagatgttcgtcagggtctcggaggcccccagcacctgccagtaagtcatcggctcggggacgtagacgatattgtcgcgcggccccagggcctccatcagctgcgcggaggtggtggtcttccccaccccgtggggtccgtctatataaacccgcagcagcgtgggcagctccggatccccgcgggctccggaggccccctggcgatggctaggacgggacgccgcgcggccgtcggtaggcccgctcgcacgagcagcctgaccgaacgcaggcgcgtgctgttggccggcgtgagaagccatacccgcttctacaaggcgttcgcccgagaggtgcgggagttcaacgccaccaggatttgtggaacgctgctgacgctgatgagcgggtcgctgcagggtcgctcgctgttcgaggccacgcgcgtcaccttaatatgcgaagtggacctcgggccgcgccgcccagactgcatctgcgtgttcgaattcgccaatgacaaaacgttgggaggtgtgtgcgtcatcctggagctaaagacatgcaaatcgatttcttccggggacacggccagcaaacgcgaacagcggaccacgggcatgaagcagctgcgccactccctgaagctgctgcagtcgctcgcgcctccgggggacaaggtcgtctacctgtgtcctattttggtgtttgtcgcgcagcgtacgctgcgcgtcagccgcgtgacccggctcgtcccgcaaaagatctccggcaacatcaccgcggccgtgcggatgctccaaagcctgtccacgtatgccgtgccgccggaaccgcagacccggcggtcgcggcgccgggtcgccgcgaccgccagaccgcaaaggcccccctccccgacacgtgacccggaaggcacggcgggtcatccggccccaccagagagcgaccccccctccccaggggtcgtaggcgtcgctgcggagggtgggggtgtgcttcagaaaatcgcggcgcttttttgcgtgccggtggccgccaagagcagaccccggaccaaaaccgagtgaggttctgtgtgttgtttttttttttttttcctcgttttgttttctcttctttcccccccccctcccccgcttctggccaagcatcctcacctgcttaagcggaacccgcgggcgcgcggggactcatttgtcgccggcgacacccacccgacaacagcccctgggtgtcgaccgctgtcgcccccgtctgtcgcctctcccttttttccccccctcaaagaacgtggtgttgggcgccggccaattcttcccggagcgccgtcgtcgcccgcccgccgccctcgaacatggacccgtactaccctttcgacgcgctggacgtttgggaacacaggcgcttcatcgtcgccgactccaggagcttcatcacccccgagttcccccgggacttctggatgttgcccgtgttcaacatcccccgggagacggcggcggagcgggcggcagtgctgcaggcccagcgcaccgcggccgcggcggccctggagaacgccgccctccaggccgccgagctgcccgtcgacatcgagcgccggatacgcccgatcgagcagcaggtgcatcacatcgccgacgccctggaggcgctggagaccgcggcggccgcggccgaagaggcggatgccgcgcgggacgccgaggcgaggggggagggcgctgcggacggggcagcgccgtcgcccaccgcgggccccgccgccgcggagatggaggttcagatcgtacgcaacgacccgccgctacgatacgataccaacctccccgtggatctgctacacatggtgtacgcgggccgcggggccgcgggttcgtcgggagtcgtctttggtacctggtaccgcacgatccaggaacgcaccatcgcggacttccccctgaccacccgcagcgccgactttcgagacgggcgcatgtccaagaccttcatgaccgcgctggtcctgtctctgcagtcgtgcggccggctgtacgtgggccagcgccactattccgccttcgagtgcgccgtgctgtgtctgtatctgctgtaccgaaccacccacgagtcctcccccgatcgcgatcgcgctcccgttgcgttcggggacctgctggcccgcctgccgcgctacctggcgcgtctggccgcggtaatcggcgacgagagcggacgcccgcagtaccgctaccgcgacgacaagctgcccaaagcgcagttcgcggcggccggcggccgctacgagcacggggccctggccacccacgtcgtgatcgccacgttggtgcgccacggggtgctaccggcggccccgggcgacgttccccgagacaccagcacccgcgtgaaccccgacgacgtggcccaccgcgacgacgtcaaccgcgccgccgccgcgtttttggcacgcggccacaacctcttcctgtgggaggaccagacgctgctgcgggcgaccgccaacaccattacggccctggccgtgcttcggcggctcctcgcgaacggcaacgtgtacgcggaccgcctcgacaaccgcctgcagctgggcatgctgatcccgggagccgtcccggcggaggccatcgctcggggggcgtccggattggactcgggcgccataaaaagcggcgacaacaacctggaggcgctgtgcgttaactatgtacttccgctgtatcaggcagaccccacggtcgagctgacccagttgtttccggggctggccgccctgtgcctggacgcccaggcggggcggccactggcgtcgacgaggcgcgtggtggatatgtcgtcgggcgcccgccaggcggcgctcgtgcgcctcaccgcgctggagctcatcaaccgcacccgcacaaacaccacccctgtgggggagattattaacgcccacgatgccttggggatacaatacgaacagggcctggggctgctcgcccagcaggcacgcatcggcttggcgtcaaacaccaagcgattcgccacgttcaacgtgggcagcgactacgacctgttgtactttttgtgtctcgggttcattccccagtacctgtccgtggcctagggaagggtgggggtggtggtggtggggtgtttttctgttgttgtttctggtccgcctggtcacaaaaggcacggcgccccgaaacgcgggctttagtcccggcccggacgtcggcggacacgcaacaacggcgggccccgtgggtgggtaagttggttcgggggcatcgctgtattcccttgcccgcttccacccccccccccttcccgttttgtttgtttgtgcgggtgcccatggcgtcggcggaaatgcgcgagcggttggaggcgcctctgcccgaccgggcggtgcccatctacgtggccgggtttttggccctgtacgacagcggggacccgggcgagctggccctggacccagacacggtgcgtgcggccctgcctccggagaaccccctgccgatcaacgtagaccaccgcgctcggtgcgaggtgggccgggtgctcgccgtggtcaacgaccctcgggggccgttttttgtggggctgatcgcgtgcgtgcagctggagcgcgtcctcgagacggccgccagcgccgctatttttgagcgccgcggacccgcgctctcccgggaggagcgtctgctgtacctgatcaccaactacctgccatcggtctcgctgtccacaaaacgccggggggacgaggttccgcccgaccgcaccctgtttgcgcacgtggccctgtgcgccatcgggcggcgccttggaaccatcgtcacctacgacaccagcctagacgcggccatcgctccgtttcgccacctggacccggcgacgcgcgagggggtgcgacgcgaggccgccgaggccgagctcgcgctggccgggcgcacctgggcccccggcgtggaggcgctcacacacacgctgctctccaccgccgtcaacaacatgatgctgcgtgaccgctggagccttgtggccgagcggcggcggcaggccgggatcgccggacacacgtaccttcaggcgagcgaaaaatttaaaatatggggggcggagtctgcccctgcgccggagcgcgggtataaaaccggcgccccgggtgccatggacacatcccccgccgcgagcgttcccgcgccgcaggtcgccgtccgtgcgcgtcaagtcgcgtcgtcgtcttcttcttcttcttttccggcaccggccgatatgaaccccgtttcggcatcgggcgccccggcccctccgccgcccggcgacgggagttatttgtggatccccgcctctcattacaatcagctcgtcaccgggcaatccgcgccccgccacccgccgctgaccgcgtgcggcctgccggccgcggggacggtggcctacggacaccccggcgccggcccgtccccgcactacccgcctcctcccgcccacccgtacccgggtatgctgttcgcgggccccagtcccctggaggcccagatcgccgcgctggtgggggccatcgccgccgaccgccaggcgggtgggcttccggcggccgccggagaccacgggatccgggggtcggcgaagcgccgccgacacgaggtggagcagccggagtacgactgcggccgtgacgagccggaccgggacttcccgtattacccgggcgaggcccgccccgagccgcgcccggtcgactcccggcgcgccgcgcgccaggcttccgggccccacgaaaccatcacggcgctggtgggggcggtgacgtccctgcagcaggaactggcgcacatgcgcgcgcgtacccacgccccctacgggccgtatccgccggtggggccctaccaccacccccacgcagacacggagacccccgcccaaccaccccgctaccccgccaaggccgtctatctgccgccgccgcacatcgcccccccggggcctcctctatccggggcggtccccccaccctcgtatcccccagttgcggttacccccggtcccgctcccccgctacatcagccctcccccgcacacgcccacccccctccgccgccgccgggacccacgcctccccccgccgcgagcttaccccaacccgaggcgcccggcgcggaggccggcgccttagttaacgccagcagcgcggcccacgtgaacgtggacacggcccgggccgccgatctgtttgtgtcacagatgatggggtcccgctaactcgcctccaggatccggacttggggggggtgtgtgttttcatatattttaaataaacaaacaaccggacaaaagtatacccacttcgtgtgcttgtgtttttgtttgagaggggggggtggagtgggggggaaagtgggccgaatgacacaaaaattaggtcggaggggtgaggggggggggctaggagccgaaccgatggcccccacacgcgacggaaggcccggaagactaccacggggagggggtgtggaaagcgaccggtcgcagggagacggggttggtttggggttggtttggggttggttttcccgttagcacatgtctgcatttgtttttctagtcacacgccccccccccccaaataaaaaccaaggcaaaacaataccagaagtcatgtgtatttttgaacatcggtgtctttttatttatacacaagcccagctcccctcccctcccttagagctcgtcttcgtctccggcctcgtcctcgttgtggagcggagagtacctggctttgttgcgcttgcgcagaaccatgttggtgaccttggagctgagcagggcgctcgtgcccttctttctggccttgtgttccgtgcgctccatggccgacaccaaagccatatatcggatcatttctcgggcctcggccaacttggcctcgtcaaacccgcccccctccgcgccttcctccccctccccgcccacgcccccggggtcggaagtcttgagttccttggtggtgagcggatacagggccttcatgggattgcgttgcagttgcaggacgtagcggaaggcgaagaaggccgcgaccaggccggccaggaccagcagccccacggcaagcgccccgaaggggttggacataaaggaggacacgcccgagacggccgacaccacgccccccactactcccatgactaccttgccgaccgcgcgccccaagtcccccatcccctcgaagaacgcgcacagccccgcgaacatggcggcgttggcgtcggcgcggatgaccgtgtcgatgtcggcaaagcgcaggtcgtgcagctggttgcggcgctggacctccgtgtagtccagcaggccgctgtccttgatctcgtggcgcgtgtagacctccaggggcacaaactcgtggtcctccagcatggtgatgttcaggtcgatgaaggtgctgacggtggtgacgtcggcgcgactcagctggtgagagtacgcgtactcctcgaagtacacgtagcccccgccgaagatgaagtagcgccggtggcccacggtgcacggctcgagcgcgtcgcgggtgaggcgcagctcgttgttctcgcccagctgcccctcgatcagcgggccctggtcttcgtaccgaaagctgaccagggggcggctgtagcacgtccccggccgcgagctgacgcgcatcgagttctgcacgatcacgttgtccggggcgacgggcacgcacgtggagacggccatgacgtctccgagcatgcgcgcgctcacccgccggccgacggtggcggaggcgatggcgttggggttgagcttgcgggcctcgttccagagagtcagctcgtggttctgcagctcgcaccacgcgacggcgatgcgccccagcatgtcgttcacgtggcgctgtatgtggttatacgtaaactgcagccgggcgaactcgatcgaggaggtggtcttgatgcgctccacggacgcgttggcgctgggcgcctcccgcagtggcgcgggcgtggcattccggggcttgcggtcctgctcccgcatgtactcccgcacgtacagctcggcgagcgtgttgctgaggaggggctggtacgcgatgaggaagccccccgtggccaggtagtactgcggctggcccaccttgatgtgcgtggcgttgtacttgcgcgcaaacatgcggtcgatggcctcgcgggcatcccggccgatgcagtcgcccaggtcgacgcgcgagagcgagtactcggtcaggttggtggtgaaggtggtcgagatggcgtcggaggagaagcggaaggagccgccgtactcggcgcggagcatctcgtccacctcctgccacttggtcatggtgcagaccgccggtcgcttcggcacccagtcccaggccacggtaaacttgggggtcgtcagcaagttgcgggtcgtcggcgacgtggcccgggccttcgtggtgaggtcgcgcgcgtagaagccgtcgacctgcttgaagcggtcggcggcgtagctggtgtgctcggtgtgcgacccctcccggtagccgtaaaacggggacatgtacacaaagtcgcccgtcgccagcacaaactcatcgtacgggtacaccgaccgcgcgtccacctcctcgacgatgcagttgaccgtcgtgccgtaccgatggaacgcctccacccgcgaggggttgtacttgaggtcggtggtgtgccacccccggctcgtgcgcgtggcgaccttcgccggcttgagctccatgtcggtctcgtggtcgtcccggtgaaacgcggtggtctccatgttgttccgcacgtacttggccgtggagcggcagacccccttggcgttaatcttgtcgatcacctcctcgaagggaacgggggcgcggtcctcgaatatccccataaactgggagtagcggtggccgaaccacacctgcgacacggtcacgtctttgtagtacatggtggccttgaatttgtacggggcgatgttctccttgaagaccaccgcgatgccctccgtgtagttctgcccctccgggcgcgtcgggcagcggcgcggctgctcaaactgcaccaccgtggcgcccgtcgggggcgggcacacgtaaaactgggcatcggcgttctcgaccttgatttcccgcaggtgcgcgcgcagcgtggcgtggccggcggcgacggtcgcgttggcgtcggggggcggggtcgcctcgggccgcttgggcggctttttggttttccgcttccgggccttggtggtcgcggggctcgggacggggggcggccgggaggcgggacccccgttcgccgcgacggtcgcggccacgccgcccgaggcgcggggggccgccggggccgccggggccgccgacgccaccgcggccaccagcgcccccacgaccagcgcgcaaatcaagccccccccgcgcatggcgggcctacgggggcgcgtcgctcccgccgcccgctagtctgggggcgaggtgctgcaggaccgagtagaggatggaaaaaacgtctcggtcgtaaaccacgaccgagcggggtccgatgcagccgtcggggccgctctcgacgatggccaccagcggacagtcggagttgtacgtgaggtacacgcccggcgggtagcggtacagaccttcggaggtcgggcggctgcagtcggggcggcgcaactcaagctccccgcaccggtagaccgacgcaaagagtgtggtggcgataatgagctcgcgaatatatcgccaggcggcgcgctgggtgggcgtgattccggaaacaccgtcaaaacagtagaacttttgaaactcgctgacggcccaatcagcgcccgaaccccccgcgcccatgatgaagcgggcgagttcctccttgaggtgcggcaggagccccacgttctcgacgctgtagtacagcgcggtgttggggggctgggcgaagctgtgggtggagtggtcgaacaggggcccgttgacgagctcgaagaagcgatgggtgatgctggggagcagggccgggtccacctggtggcgcagcagcgacgctcgcatgaaccggtgcgcgtcaaacacgcccggggcggcgcggttgtcgatgaccgtgcccgcgcccgccgtcagggcgcagaagcgcgcgcgcgccgcgaagccgttggcgaccgcggcgaaggtcgcgggcagcacctcgccgtggacgctgacccgcagcatcttctcgagctccccgcgctgctcgcgcacgcagcgcccgaggctggccagcgaccgcttggtcaggcggtccgcgtacagccgccggcgctcccgcacgtccgcggcggcccgcgtcgcgatgtcgccccagctctccggcccctgcgcccctggctcggggccgcgctccccgtcctcgctcgcgggcgtccccgcgccacgcctccgccccccctcctccgcggcggcccggggctcttcctcctcggcccccccggtcgcgccgccggcccccagccgcgccagcacgcggcgcagcgcctcctcgtcgcactgctcggggctgacgagccgccgcagcagcggcgtcgtcaggtggtggtcgtagcacgcgcgtatcagcgcctcgatctgatcgtcgggcgacgtcgcctggccgccgatgatcagggcgtccaccatgtccagcgccgccaggtggcccccgaacgcgcgatcgaagtgctccgcccgccgcccgaacagcgccagctccacggccaccgcggcggtctcctgctgcagctcgcgctgcgccagcgcgttcaggttgtcggcgaaggcgtccatggtggagtggcgggcgcgatcgccggacgccagccagaagcgcagctcgctgatggcgtacaggccgggcgtagtggcctgaaacacgtcatgcgcctccagcagggcgtcggcctcctcgcggacagaagagctatcggcgggcggcgggccggcccgggccccgccgcccgccgcggtccgcgccagcgcctggtccagcacacagagcgctcgcgcgcgggcggcgtccgacagcccggcggcgtggggcaggtaccgtcgcagctcgttggcgtccagccgcacctgggcctgttgggtgacgtggttacagatgcggtccgccaggcggcgggcgatggtcgccccctggttcgcggtgacgcacagctcctcgaaacagaccgcgcacgggtgggacgggtcgctcagctccgggggcacgatgaggcccgaccccaccgccgccaccataaactcccggacgcgctccagcgcggccgtggcgccgctcgggggggtgatgaggtggcagtagttcagctgcttgagaaaattctcgacatcatgcaggaagcacagctccatgcggacgtccccgccgtacgtctgcagccggatctgctggtggtacggacagggtcgggccagacccatggtctcggtgaaaaaggcagagacgtcacccgtggtcgcgaacgtttccaggtggcccaggagccgctccccctcgcgccacgcgtactccaggagcaactccagggtgaccgacagcggggtgagaaaggcggcggcctgagcctccagccccggccgcaggtgccgccgcagcacgcgcacctggagcgcgttgagctttagctgggcgagcttccccaggccgatctgggggtcgcatcgtcgaagcagctctagctgaaaaacgtacgtctgtacctgcccgagcagggccaacagtttctgtcgggccgcagtgggctcggaaaccgcggccgggggcgcggccgccatggcgagtcacccggccgtgctgtggtttagttaaggtttgggggggggtgggtcagaggcgcgccccgcgcggactgatgcggcggcgggcccctgacatcccctctttatgcccgtcgcccgcccgcccgccccgccggtgtgccgtgattcgcggagtcggggccttgtgtttctttctttcccccccgaatccgttctttcttcctcacccccccctccccacacacccacccaggactcgccaccacaaggaggcgagagcccgtcgctaacccaaagacacagtcacgagacacgatatcgactgtagttgcgatcgtttattttatacacaacaccaacctttccttcgaccccccccacccccgcccctagagcatatccaacgtcaggtcctttttctccggtggtccctccccaaacggatcgtcgccgtgaaacgcccgctttcgggcgacgccggccgcccccgccgccgccgccaaaccgccgaacgacgccgcgtggtcatcctcgtcgccgaaatccccaaagttaaacacctccccggcggcgccgagctggctgaccagggcctccgcctcgtgggccacctccagggccgcgtcggtcgaccactcgccgtgcccgcgctccagggcgcgggtggtaaactccatcatttcctcgctcaggtactcgtcctccagcagcgccagccagtcctcgatctgcagctgctgggtgcgggggcccaggctcttgacggtcgccacaaacacgctgctggcgaccgccgccccgccctccgcaatgatgccccggagctgctcgcacagcgaatgctcgtgggccccgcccccgagactcgacgccgcgcacacaaacccggccctggggcaggccaggacaaacttgcgggtgcggtcaaagatcagcagcgggcacgcgtttttgccgcccagcaggctggcccagttcccggcctgaaacacgcggtcgttgccggccatgccgtagtatttgctgatgctgaggcccagcacgaccatcgggcgcgcggccatcacgggccgcagcaggttgcagctcgcgaacatggacgtccaggcgccggggtgcgcgtcgagggagtccatcagcgcgcgggccccggcctccaggcccgcgccgccctgcggggcccaggcggccgccgcctgcacgctggggggacggcgggacccggcgatgacggccgtgagggtgtttatgaagtacgtcgagtggtcgcagtacctcaagatctggttggccatgtagtacatggccagttcgctcacgttattgggggccaggttgataaagttaatcgcgccgtagtccagggagaacctcttaatgaacgcgatggtctctatgtcctcgcgcgacaagagccgggcggggagctggttgcgctggagggcggtccagaaccactgcgggttcggctggttcgaccccgggggcttgccgttgggaaagatgaccgcgtggaactgcttcagcaggaagcccagcggtccgaggaggatgtccacgcgcttgtcgggcttctggtaggcgctctggaggctggcgacccgcgccttggcggcctcggacgcgttggcgctcgcgcccgcgaacaacacgcggctcttgacgcgcagttccttgggaaacccaagggtcacgcgggcaacgtcgccctcgaagctgctctcggcgggggccgtctggccggccgttaggctgggggcgcagatagccgccccctccgagagcgcgaccgtcagcgtcttcgccgacaggaacccgttgttgaacaggtccatgacgcgccgccgcagcaccggttggaattgattgcgaaagttgcgcccctcgaccgactgcccggcgaacaccccgtggcactggctcagggccaggtcctggtacacggcgaggttggaccgccgcgcgaggagctgcagcagggggcacggcccgcaggtgtacgggtccagcgacagcgacatggcgtggttggcctcggccagaccgtcgcggaacttaaagttgcgcccctcgatcaggttgcgcatcagctgttccacctcgcgatccaccagctgcttgatgttgttcaccaccgtgtgcagggcctcgcggttgccgataatcgtctccagcctccccagggccgtgggcaccgcctggtccacgtactgcagggcctcgagctcggccatgacgcgctcggtggccgcgcggtacgtctcctgcatgatggtccgggtgttctcggacccgtccgcgcgcttcagggccgagaaggcggcgtagttccccagcacgtcgcagtcgctgtacgcgctgttcatcgttccgaagaccccaatggccccccgggcggcgctcgcgaacttggggtggcgggcccgcagccgcatcagcgtcgtgtgcgcgcaggcgtggcgggtctcgaaggtacacaggttgcagggcacgtcggtctggcccgagtccgcgacgtagcgaaacacgtccatctcctggcgcccgacgatgactccgccgtcgcagcgctccaggtaaaacagcatcttggccagcagggccggagagaacccgcacagcatggccaggtgctcgccggcgaactcctgggttccgccgacgaggggcgccgtggggcgcccctcgtacccgggcaccacgtggccctcgcggtccagctgcgggttggccgccacgtgcgtgccgggcacgagaaagaagcggtaaaaggagggcttgctgtggtccttggggtccgccggcccggcgtcgtccacctcggtcaggtggagggccgaattggtgctgaacaccatggcgcccacgaggcccgcggcgcgcgccaggtacgccccgacggcgccggcgcgggccgcgggcgtttcctggccctcaagcaggggccacgtggtgatgtcggggggcggctcgtcaaagaccgccatcgacacgatggactccagggccagggcggcgtcgcccgccatcaccgaggccaggcgctgctcaaacccgcccgccgggcccttgttcccggcgtcgcgcgcgccccgctggggcttaccctggctggcctcgaaggccgtgaacgtaatgtcggcggggagggccgcgccctcgtggttttcgtcgaacgccaggtgggcggccgcgcgggccacggcgtccacgttccgggcacgcagggccacggcggcgggcccgacgaccgcctcgaacagcaggcgggcgagggggcggttgaaaaacggaagggggtagttgaaattctccccgatcgatcggtggttgcagttaaacggatcggcgatgacccggctaaaatccggcataaacatctgcagcggatacacggggatgcggtgaacctccgcgtccccgatggttaccttgtccatcccgcccagatgcaggaaggtgttgctgatgcacacggcctcccggaagccctccgtgatcaccagatacagcaaggcccggtccgggtccagtccgagccgctcgcacagcgcgtcccccgtcgtctcgtgctttaggtcgcagggccggggcgcgtagtccgcgaagccaaaatggcggcgcgcccgctcgcagagccgcgtcaggttgggggcctgggtgctgggggccaggtggcggccgccgtgaaagacgtaaacggacgggctgtagtgcgagggcataagcttgagggacaccgcggtccccccaaggcccgtcgtgcgggacccgacgaccgcggccacgttggcctcaaacccgctctccacggtcaggccgacgatgaggggcgcgacggcgacgtccgcgtcgccgctgcgcgccgacagtagcgacagcagctccaggccttcggccggacaggcgcggccatacacgtaccccatcggccccggaggaaccttgacggtggtcgtcgttttgggcttggtgtccatggctttcgggagatcggcgaccggcaggaacgggggcccggcaagacgaccgggggcagacgggggaggccgcgcgtggtcgacggctgctgcccgccgtcgtctctccgatggggtcgaatgccggcgctgggggtggggtctacacccgcccgttcgccgagcggcccctggtgggggtgggatgggtgggatggggtgggcgagaatggcccgccaccggatcgcgccggacgggggggcccggggttgggcaaggtttgggcgcaaggctccagcggcgattcgagaggcctgcggatggcggcccagagctgggtatgctcggccggggcggccggtatatgtacggcgtgctgggaggggcggcgtcgggccccgcccacggtccgccacgccccgcgcgtcatcggcagggggcgtggccgcccttctaaaaaaagtgagaacgcgaagcgttcgcactttgtcctaataatatatatactattaggacaaagtgcgaacgcttcgcgttctcactttttttagaagggcggccacgccccctttgacgtcacgctcacccgggcggccggccgcccataagcgcggcctgccgggccgataaaaagaaaccgcggcgcccccgcggacaccacacactggctctcgaaccccggacgcgcagaagggacccgggcgcgggtccgccggtaagagccggggggaacatcggcaccgccatcccaccccgagctgttgggtgggcgggtgggggggctggtgaggcggtggtgggagggggcggcgtatagcaggacaacgaccggcggcgatgttttgtgccgcgggcggcccggcttcccccggggggaagccggcggctcgggcggcgtctgggttttttgccccccacaacccccggggagccacccagacggcaccgccgccttgccgccggcagaacttctacaacccccacctcgctcagaccggaacgcagccaaaggccctcgggccggctcagcgccatacgtactacagcgagtgcgacgaatttcgatttatcgccccgcgttcgctggacgaggacgcccccgcggagcagcgcaccggggtccacgacggccgcctccggcgcgcccctaaggtgtactgcgggggggacgagcgcgacgtcctccgcgtgggcccggagggcttctggccgcgtcgcttgcgcctgtggggcggtgcggaccatgcccccgaggggttcgaccccaccgtcaccgtcttccacgtgtacgacatcctggagcacgtggaacacgcgtacagcatgcgcgccgcccagctccacgagcgatttatggacgccatcacgcccgccgggaccgtcatcacgcttctgggtctgacccccgaaggccatcgcgtcgccgttcacgtctacggcacgcggcagtacttttacatgaacaaggcggaggtggatcggcacctgcagtgccgtgccccgcgcgatctctgcgagcgcctggcggcggccctgcgcgagtcgccgggggcgtcgttccgcggcatctccgcggaccacttcgaggcggaggtggtggagcgcgccgacgtgtactattacgaaacgcgcccgaccctgtactaccgcgtcttcgtgcgaagcgggcgcgcgctggcctacctgtgcgacaacttttgccccgcgatcaggaagtacgaggggggcgtcgacgccaccacccggtttatcctggacaacccggggtttgtcaccttcggctggtaccgcctcaagcccggccgcgggaacgcgccggcccaaccgcgccccccgacggcgttcggaacctcgagcgacgtcgagtttaactgcacggcggacaacctggccgtcgagggggccatgtgtgacctgccggcctacaagctcatgtgcttcgatatcgaatgcaaggccgggggggaggacgagctggcctttccggtcgcggaacgcccggaagacctcgtcatccagatctcctgtctgctctacgacctgtccaccaccgccctcgagcacatcctcctgttttcgctcggatcctgcgacctccccgagtcccacctcagcgatctcgcctccaggggcctgccggcccccgtcgtcctggagtttgacagcgaattcgagatgctgctggccttcatgaccttcgtcaagcagtacggccccgagttcgtgaccgggtacaacatcatcaacttcgactggcccttcgtcctgaccaagctgacggagatctacaaggtcccgctcgacgggtacgggcgcatgaacggccggggtgtgttccgcgtgtgggacatcggccagagccactttcagaagcgcagcaagatcaaggtgaacgggatggtgaacatcgacatgtacggcatcatcaccgacaaggtcaaactctccagctacaagctgaacgccgtcgccgaggccgtcttgaaggacaagaagaaggatctgagctaccgcgacatccccgcctactacgcctccgggcccgcgcagcgcggggtgatcggcgagtattgtgtgcaggactcgctgctggtcgggcagctgttcttcaagtttctgccgcacctggagctttccgccgtcgcgcgcctggcgggcatcaacatcacccgcaccatctacgacggccagcagatccgcgtcttcacgtgcctcctgcgccttgcgggccagaagggcttcatcctgccggacacccaggggcggtttcggggcctcgacaaggaggcgcccaagcgcccggccgtgcctcggggggaaggggagcggccgggggacgggaacggggacgaggataaggacgacgacgaggacggggacgaggacggggacgagcgcgaggaggtcgcgcgcgagaccgggggccggcacgttgggtaccagggggcccgggtcctcgaccccacctccgggtttcacgtcgaccccgtggtggtgtttgactttgccagcctgtaccccagcatcatccaggcccacaacctgtgcttcagtacgctctccctgcggcccgaggccgtcgcgcacctggaggcggaccgggactacctggagatcgaggtggggggccgacggctgttcttcgtgaaggcccacgtacgcgagagcctgctgagcatcctgctgcgcgactggctggccatgcgaaagcagatccgctcgcggatcccccagagcacccccgaggaggccgtcctcctcgacaagcaacaggccgccatcaaggtggtgtgcaactcggtgtacgggttcaccggggtgcagcacggtcttctgccctgcctgcacgtggccgccaccgtgacgaccatcggccgcgagatgctcctcgcgacgcgcgcgtacgtgcacgcgcgctgggcggagttcgatcagctgctggccgactttccggaggcggccggcatgcgcgcccccggtccgtactccatgcgcatcatctacggggacacggactccattttcgttttgtgccgcggcctcacggccgcgggcctggtggccatgggcgacaagatggcgagccacatctcgcgcgcgctgttcctccccccgatcaagctcgagtgcgaaaaaacgttcaccaagctgctgctcatcgccaagaaaaagtacatcggcgtcatctgcgggggcaagatgctcatcaagggcgtggatctggtgcgcaaaaacaactgcgcgtttatcaaccgcacctccagggccctggtcgacctgctgttttacgacgataccgtatccggagcggccgccgcgttagccgagcgccccgcagaggagtggctggcgcgacccctgcccgagggactgcaggcgttcggggccgtcctcgtagacgcccatcggcgcatcaccgacccggagagggacatccaggactttgtcctcaccgccgaactgagcagacacccgcgcgcgtacaccaacaagcgcctggcccacctgacggtgtattacaagctcatggcccgccgcgcgcaggtcccgtccatcaaggaccggatcccgtacgtgatcgtggcccagacccgcgaggtagaggagacggtcgcgcggctggccgccctccgcgagctagacgccgccgccccaggggacgagcccgcccccccagcggccctgccctccccggccaagcgcccccgggagacgccgtcgcatgccgaccccccgggaggcgcgtccaagccccgcaagctgctggtgtccgagctggcggaggatcccgggtacgccatcgcccggggcgttccgctcaacacggactattacttctcgcacctgctgggggcggcctgcgtgacgttcaaggccctgtttggaaataacgccaagatcaccgagagtctgttaaagaggtttattcccgagacgtggcaccccccggacgacgtggccgcgcggctcagggccgcggggttcgggccggcgggggccggcgctacggcggaggaaactcgtcgaatgttgcatagagcctttgatactctagcatgagccccccgtcgaagctgatgtcccgcatcttgcaataaatgtctgcggccgacacggtcggaatttccgcgtccgctggtttctctgcgttgcgtctgaccacgagcacaaacgtgctctgccacacgtgggcggcgaaccggtagccggggcacgcggtcagcatccgatcgatgagccggtagtgcaggtgggccgacgtgccggggaagatgacgtacagcatgtggcccccgtacgtggggtccgggtaaaaaagaaaccgggggtcgcacgccccccctccgcgcaggatcgtgtgcacgaaaaagagctcgggctggccgagcgtatcggccaggaggtcctggaggggggtgctgtggcggtcggccagcacgaccagggaggccagaaaggtgcggtgctcaaagatcgtattgatctgctgcacgaaggccaggatgagggcctcgcggctgacggtggccagccgcccgtcgcccgcgctgcacgcggggcagcagcccccgatccccaggtagtagcccatgcccgagagggtcaggcagttgtcggccacggtctggtccaggctgaaggggagcgacacgggggtcgtcttcaccaggggcacggagagcgagcgcacgatggcgatctcctcggagggcgtctgggcgagggcggcgaagaagccgcggtagcgacggcgctcgtgcaggcagagctccagcctgcgcgcgtgcgacggcaggctcttgcgggaggcccggcgctccacgccggggttcccggcggcggaaaagcgcgaccgccgccgggtcttgtcgcggccgggcccgggccgggagccggagcgacggggggcgatgtcatacataggtacagagggtgtgctccagggacaggagagagatcgagtgtcgtctgagcagcgcgccggcctcgcggacaaatgtggccagcgcggtgggcttcggcacaaatacctggtacgtcttgaaggtgtagatgagggcccgcagggctatacagacccgcccctcgaactcgttgccgcaggccaacttggccttgtgaagctgcagctcgtcgcgatggtcggcgcgggggtggccaaacaggacccaggggtcgacttccatctccgtgatggcgcacatcggatcgcagaacatgtgcttgaagatggcctcggggcccgcggcccgaagcaggctcacgaaccggcccccgtccccgggctgcgcctcggggtccgcctcgagctggtccacgaccggcactatgcagtcgaagaggctggtgttgttctccgagtagcggacgacggacgccctcaggcgtcgcatggccagccagtaggcccgcaccagcaacagattgcacagcaggcattccccgccggtgcgcccgcggccccggccgtgcttcagcacggtggccatcagcgggcccaggtccaggtcgggctgggcctggggctcggcgaactgcgcaaaacgcggggccgcgtcgcgcatgcgcgccccgcggtgcgcttcccaggactcgctgaccgcggcgcggcgggcgtccgcggcggcgcgcagccggggccccgactcccagacggcgggggtgccggcgagcagcagcaggatcaggtcggcgtacgcccacgtctccggctcacccccctgcgccagcgccccggcggcggcctcgaactccccgttgcgggcggcggcgcgcgtgcagcagctgtctccgcccccgcgcttgccctcggtgcagtcgagcaggcgggcgcagtccttccagttcatcagggcggtggtgagggagggttgcgttcccgagcccccgcccgcccccgcccccgccccgtcatcgcccccggaggccagggtcccgatgagggcccgggttgcggactgcgcgaggaaggaatagttggagtactgcaccttggcggcgcccggggagggcgtcggcctgggttgcttctgggcgtggcgcccgggcaccccgccgtcggtccggaagcagcagtggagaaagaaatgccggtggatgtcgttgatggtcagggcgaagcgcgcgaaggagccgacaagggtcgccttcttggtgcgcaggaagtggtggtccatgacgtagacgaactcgaaggcggccacgaagatgctcgcggcgcagtggggcgcgcccaggcacttggcgcagaggaacgcgtaatcggccacccactggggcgagaggcggtaggcctgcttgtacagctcgatggtgcggcagaccagacaggggcggtccagcgcgaaggtgtcgacggacgccgcggcgaagggccccgtgtccaagagtccctctgccgtggggtctgcgggcgggccgcgggcggaccccggcccccgcccccccgaagcctcgcgcgcggccccgcgcggccgcgggggggcgggcgcgacgtcgctctccacgtcctcgtcgagcgcgctcgcgggcggcacgcctaccacgtgacaggccgccaggagctcggcgcacagggcctcgttaagagccagaaggtcgggatcgaaggccacatacggacgctcgaacgcgccctccttccagctgctgcccggcgactcttcgcgcacggcggcgctcgacggcacccccggggcggacgtcgccatggccggtcgagcggggcgcacgcgtccgcgaacgttacgggacgcgatccccgactgcgcgctgcggtcccagaccctggaaagtctagacgcgcgctacgtctcgcgagacggcgcgggggacgcggccgtctggttcgaggacatgacccccgccgaactagaggttatattcccgaccacggacgccaagctgaactacctctcgcggacgcagcggctggcctccctcctgacgtacgccgggcctataaaagcgcccgacggccccgccgccccacatacgcaggacaccgcgtgcgtgcacggcgagctgctcgcccgaaagcgcgaacggttcgcggcggtcattaaccggttcctggacctgcaccagatcctgcggggctgacgcgcgcttcggcggggcaccggcaccgggaccgacttgttttacataacagtagggggtgggggaacgcgcacccttgcccggtcgcgatggcggggatggggaagccctacggcggccgcccgggggacgcgttcgagggtctcgttcagcgcatcaggctcattgttcccgccacgctgcgcggcgggggtggggagtcgggcccctactcgccatccaacccgccctcgagatgtgccttccagttccacggccaggatgggtccgacgaggccttcccgatcgagtacgtcctgcggctcatgaacgactgggccgatgtgccctgcaacccctacctgcgcgtgcagaacaccggcgtttcggtgctgtttcaggggttttttaaccggccccacggcgccccggggggcgcgatcacggcggagcagaccaacgtgattctgcactccaccgagacgacgggactgtccctcggagacctggacgacgtcaaggggcgcctcggcctggacgcccggccgatgatggccagcatgtggatcagctgctttgtgcgcatgccccgggtgcagctcgcgtttcggttcatgggccccgaggacgccgttcgcacgcggcggatcctgtgtcgcgccgccgagcaggccctcgcccgtcgccgccggtccaggcggtcccaggatgactacggggcggtggtggtggcggcggcgcaccactcttccggagcgcccgggccgggggtcgccgcctcgggcccgccagcgccgcccggacggggaccggcccgtccgtggcatcaggccgtgcagttgttccgggccccgcgtccgggccccccggcgcttctgttgctggcggcggggctgtttctgggggccgctatctggtgggcggttggcgcgcgcctatgaaagggggcgagccaccgtcccgcccgccagtgcatcccagacgcccgcgagccgcacatcccctccgctcccgcctccggcccgattcttacggcgcgacccaaggtcccgatggccgccccgcagtttcaccgccccagcaccattaccgccgacaacgtccgggcgctcggcatgcgcgggctcgtgttggccaccaacaacgctcagttcatcatggataacagctacccgcatccgcacggaacgcagggtgcggtgcgagagtttcttcgcgggcaggccgcggcgctgacggacctcggggtgacccacgccaacaacacgttcgccccgcagcctatgttcgcgggcgacgccgcggccgaatggctgcggccctcgttcggtcttaagcgcacgtattccccctttgtcgttcgcgaccccaagacccccagcaccccgtgagtcctcggcgggtccctccgcggccgtctctcgttgcccccctttcccccttcccgggtggttcaataaaaaacaccaacatacgatattcgcgtttgatacgtttattggggggggtgtagggcccaacgatcggcgattaacaacaccaaacaatcgagcgcgtctaacccagtaacatgcgcacgtgatgtaggctggtcagcacggcgttgctgcgctgaaacagcgccctgcgggtccgctgcagctgttgttgtatgcggcggcatgcgcggatcaaaaccgccagggcgctacgaccggtgcttcgtacgtagcgtcgcgacaagacggcatttgcctgtacgggcaaggggccaaattgcgagtgtggtgactggaggtggtcggcggccaatgggccgggtggttcgtcggcggggggcaagtgcggttccggtgggagggggtcgagcgcctcggtatcatccgagtccgagaaacgcagggagtctgcgtcggagtgttcatcatcggaggagatgtgcagcgtctgaagcagcgatgcgggtgggggcgcggagtcgacgtgaagcgcgagagaggaagcccacgaagtcacagcggacactgggaggtgggtgtttgtatgtgtgggagactcgggcgtcgggaccgagtctcggctctggggtgtaagcgtccgagttacgggcggcaggggcggctggggcaggggcggctggggcaggggcggctggggcaggggcggctggggcaggggcggctggggcaggggcggctggggcaggggcggctggggcaggggcggctggggcaggggcggctggggcaggggcggctggggcaggggcggctggggcaccgagcgcgcgcggatgcgcgtccgcgcggcgggtttggtcgcgggtgactggggtggggggcggcgggcaaccgggcctccgggcacgacccaaccgcacaaaggctcgctcggggcaaccgggcctggggccaaaggcggggggctggtctggacggcggaggtcgggggggcaaggcccggagaaggcggcactgccgccgctgcggcggaaaccgcggccgcgtggtcggctgggtcccggggagaggggagggagttcaacgaggccgagagcgaggcgaccgcggggcgcgtgaggcgccggggtgggccggccgcggggccccgggggggtgtcggcgagggacccgctgttgtctggcggcggccgcggcggcggtcgcccccggggacgaccgctccttcggcgggcggaggcgggatgggcgcgagcgtgggggcgggaaaggccccgcgagccgaggcggggccgggcggaaggggcaaagcagaaacccaagccgggggcgcggactccggggtgggcggctggtcgggaggacgcgcggaagcggcgaccggggcgaccggggcggggagtgccggcggacgccacccctcggggggggcggaggcccggggcgcgcgcgatttggcacgcgtccggcgggacctgcgcacgcgcggcacggcggcggagaaagcggcggcagagccggaaaaggccgggggaggaagcgcggcatccgcggggggactcggtgtgggtggcgagggccgtgggtcgtcgcgaggggccacgggcacgcgccccgtgttttgttgaggcgggacactcggtcgtgtttcgcgagccgtagctgccggcccgatgggccgcggtgcgtactgggacgtggggacggactgatcggtggcgggggggggaagaagggccggggccggattgggcgtggggccgccggcgtcgtcggacgccagctcctccaggccgtggatccaggcccacatgcgaggggggacgggctcgccggtggtggcgtcggtgaggagagtgggggcgaggacccccgggtccgcctgccgtgcggggggggcagcggggtcctcgggacccgatccgccatccccccccgcaaggtcccgcgggtcgcgggcggcggtcggggcagagggacctgcctcgtcggcgagggggcgctggtaaaccgggtgtcccgggaacagctcccccgtcaggagggaggcgtcgaagggccgcccgaggatggcccgcgcgaagaaggggtccgcgtcggcggcgctcgccgcgagaacgtcccccgcggtagccacaaacggaagctcctcggtggcctcgctgcccacaaaccgcacgtcaggggggccggggggctccggggcttcccacaagaccgcgaccggggtcatggagatgtccacgaggaccaggcacgggggcccgtcggcgagagggcgctcggcgatgagcgccgacaggcgcgggagctgcgccgccagacacgcgttttcgatcgggttgagatcggtgtggaggaggccgacggcccacgtctcgatgtcggacgacacgacgtcgcgcagggcggcgtccggcccgccggggcgcgagtcgaagagcgtcaggcacagttccagttccgactcgcgggagaaggccgtggtgttgcggagcgccaccacgacgggcgcgccgaggagcaccgcggccagaaccaggtccatggccgtaacgcgcgcggcgggggtgcggtgggtcgcggcggccagcacggccacgtgctggcccgtgggtcggtagagggcgtggggggcctcggggagggacgccttgcgcccccccgccgggccgagcgtctggccagactccaggcgtgcggccaggagggcgtcgaagctgtcgtactcggtgtagtcgtcgggaaacatgcaggtccacagcgcggccaaagcggcgctcggcagacacatgcgcccgaggacgctcaccgccgccagggcctgggccggactgagcttcccgagcgccgggacgtcccggcgctgggtcccgagctccaaggccgagcgccagggcgccagcgggtcggtttcggacagcttgccccggcgccagtcggccagccgcgtgccgaacaggaggccccgggtcggggggcctccgtccaaaaacgtcggcaacacgcggatgcgggcgtcgggatgcggggtcaggcgctggacgaacagcatggactccgctgcgtcctcgaacgcgcgttcgagggtgaggtgcatgtactcgtgctggcgaacgaggtccaggcgccagaagttgtagatgtgttccggaacgccggccaccagcgcgaccagcacgtcgttctcgttgaaggcgacgcagtggcgctgggacccccgggggcccggcggcggacgcggcgccgccgctccggacgcccagcccagctgggcccagcgacacccaaactcgcgcgtgagggtggtggcgacgagggcgacgtacagctcggccgccgcgtccatcgaggcgccccacgtcgcctggcgatggcgcacgaagcgaccgaacagctgaaagttggcggcctgggcgtcgctgagggccagctggagccggttcacgacggtcagcacgtacatggccgtgaccgtcggggccgattcgaggacgtccgtcggaagcgggggccgcacgcaggccgcctcgggacgcatcagcagcgcgccgagtttgtcggtgacggccgggaagcatagcgcgtactgcagcggcgttccgtccggggccaaaaagctggtggcgaacggcagatccagagcgctgacggcctcacgcagcaccaggggccccgggtctccgccggcgcgcagatacgcctcgccccggcggcgcagcagctgcgggtcgacctcgtggccctcgggggaagaagaggcccgggcgcgggcgtcgagggcgcgaagatcaacgagcaggggcgcgggcgcggactccgcgcccgcgcccgtctggccgccggccctggcgtacgcgctatataagcccatgcggtattggatgagttcccgcgcgccccggaactcctccaccgcccacggggccaggtccgcggccgccgcgtcgaactccgccagcaggcgccccagggcgtcaaagttcatctcccagggcaccctgcgcaccacctcatcccgcagccgggcgcacagggcggtgtgcttggtgacgcgcgcgcccagctcctccacggcctccgcgcgctcggcgcccttggcgcccaggacgccctggtacctggcggaaaggcgctcgtaggccggctgggcccgcagccccgacaccgtgttggtggtgtcctgcagggcgcgcagctgctcgtgcatggcgcggaacccctcgggggacttccaggcgcccccccggacgcggccaaagcgaccccagacctcgtcccactccgcctcggcctcctccagggacctccgcagggcgtcgacgcggcgccgagtatcaaagagcgcccccaggcggccggcgtgccgcgccagggggccggggccgtcgccgcgggcggcgcttagcgggtgcgtctcgaaggtgcgctgggcgtgctctagccagataaccgcgggcacgtcgagctcgcgcgttttctcggtctgatccaacagaacctcgacctggtcggcgatctccgccaccgagcgcgcctggtcgagcgtcttggccacggtcgccgggacggcgaccaccttcagcatggtcttgaggttggccaggccctcggcctcgatctgggcccggcgctcgcgcgcggccagcgcctcccgcaggcccgccatgacccgctcggtggcctccgcgcgctgctgtttggcgcgcaccactgcgtccttggtctcggccgtgtcctgccgggtcacgaaggcgacatactcggcgtacgccgtgttcttcacggggctctggtccacgcgctccaacgccgccgcgcacgcgaccagcgcgtcctcgctgggacacggcagggtgaccccggtccggaccagctccgcggtggcctccgggtcattccgggccgcggatatctgctccgcggcggccgccaggtccaggggcacgccgccgagcgcccggtgcacgtcggcccggatggcgtccaggcgatcgcggagctccacgtagtcggcgtagccatgttggaagaacggcacgtaccggcgcaggccgggcacgctcgtcatgtcgtccgccaggcgccccacggcctcgtggtagtcgataaacccgtcgcccgcctgggccatttccaggagcccctccgcgatgcgcagcagccgcgccaggggctcggcgtcgacccgaaacatgtcggcgtaggtttcggcggcggcgtggaacgccgcgctccagccgaggcggtggatggcggcgagcggggggagcatggggtggcgctggttctcgggggtgtaggggttaaacgcgaaggccgtatccagggcgagggtgaccgcctcggcgttggccgcgagcgcctgctcggcgcgcttgcggaagtcccgggggttgtagccgtgcgtgcccgccagcgcctgcaggcggcgcagctcgaccacgtcgaactcggcgcggttctcgacgcggtccagcgccgcctcgacgccggcggcccagcgctcgctgctgccccgggcgcgctgggccgccatcttcgccgtcaggtcggcgacggcggcctcaagttcgtcggcgcggcgtcgcgtggcgccgatgaccttgcccagctcctgcagggcgcgcccgctgggggaatggtccccggccgtcccttcggcgtgcagcaggcccccgaacccagcctcgtgccccgcgaggctttcccgagcagcggtcgtcgcgcgggccgcggcatcgatgagggcggcatggtccccctccggctgggcgcaggcccggcgcgcctggactaccaggtcggcggccgccgaccccagggtcgtgagctcgtcgatggccccccgcgcctccagggccagccgagtcgcctttacataccccgcggcgctatcggccagcaccgcgaggaaggacaggggcgaggccgggtcgcgggcggccgcgcccagggccgacaccgcgtccgccagggcgccatgcgcccgcacggccgcgtccaccgtcgccgcgggacttgccgtcgcgacggcggcgctcccggcgttgatggcgtttgacacggctttggcgattgtgggggcgtgatcggaaaagaactgcacgaggaccggcgtctcgggggcgtcggcgaacagggtcttcagcaccaccacgaaggcgggatgcaggccggccagagccgtcgcggtatccggggtcgggtgttccagggcctcccggtactgccccagcagcccccacaggtccgcccgcagcgccgccgtgacttccgggggggggccccggacggcatcggccaggtcggtccaccccgcgggcagggaggcccgcagggtcgccagcacggccggacacgcctttagccccacaaagtccgggaggggccgcaggaccccttggagtttgtgcaggaacttctcccgggcgtcgtgggccaccttggcgcgctcccgcgcgtcgttgagcatcgcctccagggcgtgggcgcgctcccgaagccgggagcgcgcctccggagcgagctccgccgtcatcttggccgcctccatggccctcgcctgccgcagcgcgtcttcggccatgcgcgtggcctcgggggacagcccgcccccgtcgacgtacggcgcggggccggtcgccgggacgaaggccgcgtcgctgtccagctgctgcgcgagcgccgcgtcgagggcgtcgaagcgctgcagttcggccagccccgagctgcgccgcgcctgctggtcgttgatgccgtggatgctgcgcgccagctcttccaggggcttgcgttcgatgagcccctgggtcgcggcgtcggtcaggaccgagagccaggccgccaggtcctcgggggcatctagggtctggccccgctggagcaggtcccgcagcaggatggcctgggggctggtggcgagggggggcgggggggggagcgcggcgcgctgagcgacgtcccgcgtgtgttggtcaaaggccggtagcgattccagcaactggaccatgggcacgaccgcggccgaggccacgtgaaaccgacagtcgtggctgtcgctggcctgcagggccttcgcgctgtatacggctccccggtggaagtactccttgaccgcgctctcgatcgcccggcgggcctggatccgcacgtcctccagccgcgcctggatggcctcggggcccagggcgggcgggcacggggccctgccgccggcgcccggggcggcgggcacgggcatcacggtcaggggcccggcgcgctgcgagaccgagtcgaccccgcgggcgagggcgtctaaggcctcgcgcatctcgcgggcctccgcctcgacccgcatctcttcgccccgggcaaactgggccagcgcctggatccgatggagaagcggctccgggtgcgtcggggtggcgggggcgaacagggtgttcgggtgggcgcgcgagcgctccaggagccactctccgaggcgtgcgtacagattggccggcggggcggcgcgcagctgcagatccaggtccgcgaggtccccgtaaaaggcgtccgtctcccgaataacgtccctggcgaccaggaccagcttagcgagggccaggcgcccgatctgcgaattttcgtccagcacgtgctggatgaggggccggtgggcggccacgtccgccaggctcatgcgcgtggacgccaggaagtccccgacggccgttttgcggggcagcatgcgcagggtgaagtccagcagggccgcggccgggccggccaccccggcctgcgtatgcgtgcgggccccgttctcgatcaaaaaggcgaggacgcgctcaaagaagaagatgacgcagagctccaacagccccgggtgcgccgggtacggcgaccgcagggcgttgatggtgagctgcgaacacgcggccacctcgcgggccagggcggcatcgcgcgccgcgagccggaccgccgtggcggccacattggggtggacctcgaacagctgcgccaggtcggcgccggggggctccggggggcggcgggcccccagcgtctcgagcacggacggcgacgacgggctcgcgggcccgtcgtcgccgccgccctgcccggactgcgggggggtatccggtgcgggagggaccgtggcggctatgggcgtcggggaggaggcggggacctcggcggcgacgggggccttcttcttgggcgcggacttcttcttggccttggcgggcggggccttgggggcgggcctctcgcccgaggtcagatcctccacgctggacggtggggtccaggtgggccggcggcgcttgggcaagccggtagaatagcgcgcccggtggcgacccaccggcactgcccccacctccaggacccgcaggtcctcggcttcttcggccgcgtccccggcgggtgtctgcgggggcggggcggcgtgcggtggacccgaggccgcggcgtccggggccgagggcttcgcgggcggggtcccctccagggctgctgcccacacatcatcgggggggcggtttgggtgccccgcctgcggtgtgtcgggtgggcccgaggccccccggggggcctcggggggccggtcggccccaggggtctggacgtgggtgggcgcggggagcgcggggacgaccgggcccgagccttctccgtcccccctggggaccacaccgacaaagagcgccccgagccccccgatctcgccccgcagggggtgggtgatggccacgcgccgctcgacgaacggttcgtcctgcaggtaagtctcgctggccccgtagaggtgcagggccgcggcggtcaggtccgccggcgccacggcccccgggccggagggcacaaaaaacaccatggcgcccgcccaccgcaccttggggcggtcgtgggcgtaatacgtcaggtacgggtacacgtcgcccgcccgcaccttggcgataaacgcgggcgttcccgcgggcaggccgtgcgggtcaaacagataggccgtgtcgccgtcccggtagagccccatgcccagggggccgatggtcaggagcgtgtaggacagcggccgcatggcccaggggccggcgaagaacgtgtgcgcggggcattgcgtctccagcagccccgccgtgggctccccgaagaagcccacctcgccgtacacccgcgaaaacacgcaacgcaggccgccgcgcgccgccgggtactccaggaagttggggagctcgataatggaacacatgcgcggcggcccggagcccgcggccgcgcgcgtccactcgcccccctccaccagacatccctcgatggcctccgcggacagcacgtcgcggggccccacgtcgaaaagaagactgagaaacgacagggacgagcgcatgcacgataccgacccccccggctccagatcggtcgcgaactggttccgaacaccggtgaccacgatatcgcgatccccctggcgcttcatcgtggggtgaggtagcgcggccggaatcatgtgtgccgcgcccgccacgagcggggcctgtttatgggccgggcgtcccgatgagtactgttgtttccgccgcccgaacccccccgcccatcaaccgcctgttcgtccccctaaccacacacccggtatcgcgtgtgtgtggtttcccgggaagacacatcccaccccatgaagttttgccctttttttccgtcccgcactacgccacctttccaccccccccccaaaaaaacaacaaccaactcccagatggatgggtgcgataataaagctttattattgtttaaccaaaggcgagtcctacgggtgtaccggtggtgtctcctgcggcgtcatctcgtcgtcctccacgggggtgttgggccaagggaccgtctcgcggcccgccgggcgcgtcgacggcgcgcgggcctgcgtgtcctgtgggccgggtgtcgtgggttcgggggtgctaccgccggcatcttgggcctccaggtccccgggggcccccgggccggcggaaggccgaaacgccgaggcgcgaaacacgccgtcggtgacctgcaggagctcgtttattaatagccagtccatgctcagcgtagcggccagcccctggggagacaggtccacggagtccggaaccaccgtcggctgacccaggggccccaggctgtagtccccccaggcccccaggtcatgacggttcgtgagcacgacgaggtctgcggccgggctggggggcgcgtcctcggtcgcgtgggccatcacctcctgaatggctgcggtgcgctgatcggccgagctggcgaagggcgccacgaccagcgcgcgctccgtctgcaggcccttccacgtgtcgtggagttcctgaacgaactcggccacccgctcggggcccgtggccgcgcgtgcggcctgatagccggccgagaggcgccgccagcgcgccaggaactgactcatgtaacagaacccggggacctggtcccccgacatcaactttgacgccctggcgtggatgcccgacacgatggccaggaacccgtggatttcccgccgcacgacggccagcacgttaccctcgtgcgagacctgggccgccagctcgtcgcataccccgaggtgcgccgtcgtctcggtgacgacggaccgcagccccgcgagggacgcgaccagcgcgcgcttggcgtcgtgatacatgccgcagtactggctcaccgcgtcgcccatggcctcggggcgccagggccccaggcgctcgtgggcgtctgcgaccacggcgtacaggcggtgcccgtcgctctcgaaccggcactcaaagaaggcggcgagcgtgcgcatgtgcagccgcagcagcacgatcgcgtcctccagctggcggaccagggggtcggcgcgctcggcgagctcctgcagcaccccccgggccgccagggcgtacatgctgatcagcagcaggctgctgcccacctcgggaggctgggggggaggcagctggaccgcgggccgcagctgctcgacggcccccctggcgatcacgtacagctcgcgcagcagctgctcgatgttgtcggccatctgcatcgtgggcccgacgccggcccgggtggccggttcgaggagggtgatcagcgcgcccaattttgtgcggtgcccctcgacggtggggagatagcccaggccgaagtcgcgcgcccaggccagcacccgcagggcaaactcgatggggcggggcaggtaggcagcgttgcacgtggccctcagcgcgtccccgaccaccagggccagcacgtaagggacgaaccccgggtcggcgaggacgttggggtggatgccctccagggccgggaagcggatcttggtggccgcggccaggtgaaccgagggggcgtggctaggcggcccgacggggagcagcgcggacagcggcgtggccggggtggtgggggtcaggtcccagtgggtctggccgtacacgtcgagccagatgagcgccgtctcgcgcaggaggctgggctggccggcgctgaagcggcgctcggccgtctcaaactcccccacgagcgtgcgccgcaggctcgccaggtgttccgtcggcacggccgggcccatgatgcgcgccagcgtctggctgaggacgccgcccgacaggccgaccgcctcacagagccgcccgtgcgtgtgctcgctggcgccctggatccgccggaacgttttcacgtagccggcgtagtgcccgtactcccgcgcgagcccgaacacgttcgcccccgcaagggcaatgcacccaaagagctgctggatctcgctgagcccgtggccggggggcgtccgcgcgggcacccccgccaccaaaaacccctccagggccgatatgtactgggtgcagtgcgcgggcgtgaaccccgcgtcggtaagcgtgttgatcaccacggagggcgagttgctgttctggaccaaagcccacgtctgctgcagcagcgcgaggagccgttgctgggccccggcggagggcggctcccctagctgcagcaggccggtgacggccggacggaagatggccagcgccgacgcactcagaaacggcacgtcggggtcgaagacggccgcgtccgtccgcacgcgcgccatcagcgtccccgggggcgcgcacgccgaccgcgggctgacgcggcttagggcggtcgacacgcgcacctcctcgcgactgcgaaccattttggtggcctcgaggggcgggatcatgatagccgggtcgatctcccgcaccgtgtgctgaaactgggccagcagcggcggcgggaccaccgcgccccgatcgggggtcgtcaggtactcgtccaccagcgccagcgtaaacagggcccgcgtgaggggggtcagggcggcgtcgtcgatgcgctgtaggtgcgccgagaacagcgtcacccaattgctgaccagggccaagaaccggagaccctcttgcacgatcggggacgggaagagcaggctgtacgccggggtggtcaggttggcgccgggttgccccaggggaaccggggacatcttaagcgacatctccccgagggcctccagggaggtccgcgggttcatggccaggcagctctgggtgacggtccgccagcggtcgatccactccacggcacactggcggacgcgcaccggccccagggccgccgtggtgcgcagcccggcggcctccagcgcgtgggtcgtgtcggagccggtgatcgccaggaccgtgtccttgatgacgtccatctcccggaaggccgcctcgggggtctcggggagcgccaccgccatgcggtgcaccagcagcccggggaggttctcggccaagagcgccgtctccggaagcccgtgggcccggtgcaaggcgcacagttgctccaggagcgggtgccagcacgcccgcgcctccgccgggccgaccgccgcgcccgacaacagaaacgccgccgtggcggcgcgcagtttggccgcggacagaaacgccggctcgtccgcgctgcccgccggctcgctcgagggggagggcggccggcggaggttggtcaggctccccaacaggacctgcaacggtccgtttgggggtggagcggacgggggggtcatgccggcgggcgccgggacctggagcgcgctgtccgacatggcgaccggcgtgcgcgctcggcgacgcggcgcggagaccgcgggcccaaacgggaatgactgccgccgccctatacggaggggctaagtatcgcccggggacccttcgaaaccccgggcgtgtcgcaagtacgccgcgaaggcgcggcgtgttatacggcgcgttatgtcccggcattccgttcgtgggttcgggcccgggtgctgtcgggtgggagtgtgtgtgggggggggcggcgcgacggcggcccggaccaagtgtatcgcggccgttccgtggggcggcccaacaggccctttaaacatttgcgtatgcaccggcccagccagtcggacaccggaacccaccagaggcggaagccgccttcgcccgtgagggtgcgtgtgttttctggtggcgtgtttttcctttccgccctcctccctccccacctccaccacccccccccacaactcgcccgttggcgatcggcgggaaaaccatgaaaaccaagccactcccgacagccccgatggcgtgggccgagagtgccgtggaaaccaccaccagcccgcgcgagctcgcgggccacgccccgctccggcgcgtcctgcgcccgcccatcgctcgccgcgacggcccggtgcttttgggggacagggcccccaggaggacggccagtacgatgtggctgctggggatcgaccccgcggagtcgtctccgggaacgcgcgctacccgagacgataccgagcaggccgtggacaagatcctcaggggagcccggcgcgcgggagggctgaccgtccccggcgccccccgctatcacctgacccgccaggtaaccctgacggatctctgccaaccaaacgcggagcgggccggggcgctccttttggccctgcggcaccccaccgacctcccccacctggcccgccatcgggctccgcccggccggcagaccgagcgactggccgaggcctggggccagctcctggaggcctccgccctggggtccgggcgggccgagagcggctgcgcgcgcgcgggccttgtgtcgtttaactttctggtggccgcgtgcgccgccgcctacgatgcgcgcgacgccgccgaggcggtccgggcccacatcacgaccaactacggcgggacgcgggccggggcgcggctggaccggttttccgaatgcctgcgcgccatggtccacacgcacgtgtttccccacgaggtcatgcggtttttcggggggctagtgtcgtgggtcacacaggacgagctggctagcgtcaccgccgtctgcagcggaccccaggaggccacacacaccggccacccgggcaggccccgttcggccgttaccatcccggcctgcgccttcgtggacctggacgccgagctgtgcctggggggccctggggcggcgttcctgtacttggtcttcacctaccgacagtgccgggaccaagagctctgttgcgtgtacgtggtcaagagccagctccccccgcgcggactggaggcggccctcgagcggctgttcgggcgcctccggataaccaacacgattcacggggccgaggacatgacgccccctcccccgaaccgaaacgttgactttccgctcgccgtcctggccgcgagctcgcaatccccgcggtgctcggcgagccaagtcacgaacccccagtttgtcgacaggctgtaccgctggcagccggatctgcgggggcgccctaccgcacgcacctgcacatacgccgccttcgcagagctgggtgtcatgccagacgacagcccccgctgtctgcaccgcaccgagcggtttggggcggtcggcgttccggttgtcatcctggagggcgtggtgtggcgccccggcgggtggcgggcctgcgcgtgatcgtctattgacgacggccgcccaacccgagcgaccttcccctcccacttccccccccctacacaccaactccgccctcgccgtcttggccgtgcgcggccccgtgcgtccgtctcaataaagccaggttaaatccgtgacgtggtgtgtttggcgtgtgtctctgaaatggcggaaaccgacatgcaaatgggattcatggacacgttacacccccctgactcaggagataggcatatcctccttagattgactcagcacacgatcgcaccccacccctgtgtgccggggataaaagccaacgcgggcggtctgggttaccacaacaggtgggtgcttcggggacttgacggtcgccactctcctgcgagccctcacgtcttcgcccaccgattcctgttgcgttcctgtcggccggtgctgtcctgtcgacagattgttggcgactgcccgggtgattcgtcggccggtgcgtcctttcggtcgtaccgcccaccccgcctcccacgggcccgccgctgtttccgttcatcgcgtccgagccaccgtcaccttggttccaatggccaaccgccctgccgcatccgccctcgccggagcgcggtctccgtccgaacgacaggaaccccgggagcccgaggtcgccccccctggcggcgaccacgtgttttgcaggaaagtcagcggcgtgatggtgctttccagcgatccccccggccccgcggcctaccgcattagcgacagcagctttgttcaatgcggctccaactgcagtatgataatcgacggagacgtggcgcgcggtcatttgcgtgacctcgagggcgctacgtccaccggcgccttcgtcgcgatctcaaacgtcgcagccggcggggatggccgaaccgccgtcgtggcgctcggcggaacctcgggcccgtccgcgactacatccgtggggacccagacgtccggggagttcctccacgggaacccaaggacccccgaaccccaaggaccccaggctgtccccccgccccctcctcccccctttccatggggccacgagtgctgcgcccgtcgcgatgccaggggcggcgccgagaaggacgtcggggccgcggagtcatggtcagacggcccgtcgtccgactccgaaacggaggactcggactcctcggacgaggatacgggttcggagacgctgtctcgatcctcttcgatctgggccgcaggggcgactgacgacgatgacagcgactccgactcgcggtcggacgactccgtgcagcccgacgttgtcgttcgtcgcagatggagcgacggccccgcccccgtggcctttcccaagccccggcgccccggcgactcccccggaaaccccggcctgggcgccggcaccgggccgggctccgcgacggacccgcgcgcgtcggccgactccgattccgcggcccacgccgccgcaccccaggcggacgtggcgccggttctggacagccagcccactgtgggaacggaccccggctacccagtccccctagaactcacgcccgagaacgcggaggcggtggcgcggtttctgggggacgccgtcgaccgcgagcccgcgctcatgctggagtacttctgtcggtgcgcccgcgaggagagcaagcgcgtgcccccacgaaccttcggcagcgccccccgcctcacggaggacgactttgggctcctgaactacgcgctcgctgagatgcgacgcctgtgcctggaccttcccccggtcccccccaacgcatacacgccctatcatctgagggagtatgcgacgcggctggttaacgggttcaaacccctggtgcggcggtccgcccgcctgtatcgcatcctgggggttctggtccacctgcgcatccgtacccgggaggcctcctttgaggaatggatgcgctccaaggaggtggacctggacttcgggctgacggaaaggcttcgcgaacacgaggcccagctaatgatcctggcccaggccctgaacccctacgactgtctgatccacagcaccccgaacacgctcgtcgagcgggggctgcagtcggcgctgaagtacgaagagttttacctcaagcgcttcggcgggcactacatggagtccgtcttccagatgtacacccgcatcgccgggtttctggcgtgccgggcgacccgcggcatgcgccacatcgccctggggcgacaggggtcgtggtgggaaatgttcaagttctttttccaccgcctctacgaccaccagatcgtgccgtccacccccgccatgctgaacctcggaacccgcaactactacacgtccagctgctacctggtaaacccccaggccaccactaaccaggccaccctccgggccatcaccggcaacgtgagcgccatcctcgcccgcaacgggggcatcgggctgtgcatgcaggcgttcaacgacgccagccccggcaccgccagcatcatgccggccctgaaggtcctcgactccctggtggcggcgcacaacaaacagagcacgcgccccaccggggcgtgcgtgtacctggaaccctggcacagcgacgttcgggccgtgctcagaatgaagggcgtcctcgccggcgaggaggcccagcgctgcgacaacatcttcagcgccctctggatgccggacctgttcttcaagcgcctgatccgccacctcgacggcgagaaaaacgtcacctggtccctgttcgaccgggacaccagcatgtcgctcgccgactttcacggcgaggagttcgagaagctgtacgagcacctcgaggccatggggttcggcgaaacgatccccatccaggacctggcgtacgccatcgtgcgcagcgcggccaccaccggaagccccttcatcatgtttaaggacgcggtaaaccgccactacatctacgacacgcaaggggcggccatcgccggctccaacctctgcaccgagatcgtccacccggcctccaagcgatccagtggggtctgcaacctgggaagcgtgaatctggcccgatgcgtctccaggcagacgtttgactttgggcggctccgcgacgccgtgcaggcgtgcgtgctgatggtgaacatcatgatcgacagcacgctacaacccacgccccagtgcacccgcggcaacgacaacctgcggtccatgggcattggcatgcagggcctgcacacggcgtgcctgaagatgggcctggatctggagtcggccgagttccgggacctgaacacacacatcgccgaggtgatgctgctcgcggccatgaagaccagtaacgcgctgtgcgttcgcggggcgcgtcccttcagccactttaagcgcagcatgtaccgggccggccgctttcactgggagcgcttttcgaacgccagcccgcggtacgagggcgagtgggagatgctacgccagagcatgatgaaacacggcctgcgcaacagccagttcatcgcgctcatgcccaccgccgcctcggcccagatctcggacgtcagcgagggctttgcccccctgttcaccaacctgttcagcaaggtgaccagggacggcgagacgctgcgccccaacacgctcttgctgaaggaactcgagcgcacgttcggcgggaagcggctcctggacgcgatggacgggctcgaggccaagcagtggtctgtggcccaggccctgccttgcctggaccccgcccaccccctccggcggttcaagacggccttcgactacgaccaggaactgctgatcgacctgtgtgcagaccgcgccccctatgttgatcacagccaatccatgactctgtatgtcacagagaaggcggacgggacgctccccgcctccaccctggtccgccttctcgtccacgcatataagcgcggcctgaagacggggatgtactactgcaaggttcgcaaggcgaccaacagcggggtgttcgccggcgacgacaacatcgtctgcacaagctgcgcgctgtaagcaacagcgctccgatcggggtcaggcgtcgctctcggtcccgcatatcgccatggatcccgccgtctcccccgcgagcaccgaccccctagatacccacgcgtcgggggccggggcggccccgattccggtgtgccccacccccgagcggtacttctacacctcccagtgccccgacatcaaccaccttcgctccctcagcatcctgaaccgctggctggagaccgagctcgtgttcgtgggggacgaggaggacgtctccaagctctccgagggcgagctcggcttctaccgctttctgtttgccttcctgtcggccgcggacgacctggtgacggaaaacctgggcggcctctccggcctcttcgaacagaaggacattcttcactactacgtggagcaggaatgcatcgaggtcgtccactcgcgcgtctacaacatcatccagctggtgctctttcacaacaacgaccaggcgcgccgcgcctatgtggcccgcaccatcaaccacccggccattcgcgtcaaggtggactggctggaggcgcgggtgcgggaatgcgactcgatcccggagaagttcatcctcatgatcctcatcgagggcgtcttttttgccgcctcgttcgccgccatcgcgtacctgcgcaccaacaacctcctgcgggtcacctgccagtcgaacgacctcatcagccgcgacgaggccgtgcatacgacagcctcgtgctacatctacaacaactacctcgggggccacgccaagcccgaggcggcgcgcgtgtaccggctgtttcgggaggcggtggatatcgagatcgggttcatccgatcccaggccccgacggacagctctatcctgagtccgggggccctggcggccatcgagaactacgtgcgattcagcgcggatcgcctgctgggcctgatccatatgcagcccctgtattccgcccccgcccccgacgccagctttcccctcagcctcatgtccaccgacaaacacaccaacttcttcgagtgccgcagcacctcgtacgccggggccgtcgtcaacgatctgtgagggtctgggcgcccttgtagcgatgtctaaccgaaataaaggggtcgaaacggactgttgggtctccggtgtgattattacgcaggggaggggggtggcggctggggaaagggaaggaacgcccgaaaccagagaaaaggaccaaaagggaaacgcgtccaaccgataaatcaagcgccgaccagaaccccgagatgcataataacgattttattactcttattattaacaggtcgggcatcgggaggggatgggggcgcgcgtttcctccgttccggctactcgtcccagaatttagccaggacgtccttgtaaaacgcgggcgggggcgcgtgggcccacagctgcgccagaaaccggtcggcgatgtccggggcggtgatatgccgagtcacgatggagcgcgctaaatcttcgtcgcggaggtcctgatagatgggcagtctttttagaagagtccagggtccccgctccttggggctgataagcgatatgacgtacttgacgtatctgtgctccaccagctcggcgatggtcatcggatcgggcagccagtccagggcctccggggcgtcgtggatgacgtggcggcgacgtccggcgacatagccgcggtgttccgcgacccgctgcgcgttggggacctgcacgagctcgggcggggtgagtatctccgaggaggacgaccgggcgccgtcgcgcggcccaccggcgacgtccgggggctggaggggggggtcttcttcgtagtcgtcctcgcccgcgatctgttgggccagaatttcggtccacgagatgcgcgtctcgaggccgaccggggccgcggtcagcgtaggcatgctctccagggagcgcgagttggcgcgctcccgccgggccgcccggcgggcctgggatcggctcggggcggtccagtgacactcgcgcagcacgtcctcgacggacgcgtaggtgttattggggtgcaggtctgtgtggcagcggacgaacagcgccaggaactgcgggtaactcatcttgaagtactgcagcaggtcgcggcagtgaatcgtcggaatgtagccggtgctgatgtccaacacgatatcgcagcccatcagcaggagatcggtatccgtggtatgcacgtacgcgaccgtgttggtatgatagaggttcgcgcaggcgtcgtcggcctccagctgacccgagttgatgtaggcgtaccccagcgcccgcagaacgcggatacagaacaggtgagccaggcgcagggccggcttcgagggcgcgcccgagggggccgccgggcctgggccggcggcccgcgttccccggtcccccggggcgaaggcgtgcccgcggcggcgcatgttggaaaaggcgaaactgggcctggagtcggtgatgggggaaggcggcggcgaggcgtctacgtcactggcctcctcgtccgtgcggcactgggccgtcgtgcgggccaggatcgccttggccccgaacacaaccggctcggtacactcgaccccgcgatcggtcacgaagatggggaacagggacttttgggtaaacacccgtaacatactacagagacagtgtagcgtgattgcctcgcggtcgtaacttgggtagcggcgctgatatttaaccaccagggtatacatgacattccacaggtccacggcgatgggggtaaagtagccctccggggcccggaggccccggcgcttcaccagatggtgagtctgggcaaacttcatcatgccaaacagacccattccggcacgattgtaggtgcggataggtctctctacagagctgtataggtgtgacggtccgggacacccaagcccgccgcccctgtgtacagtggctgcggcgacgaccccgctccaacaagacgctatcccgggaaaggcacgctctttataattcttttttatttcccatctacgtgcggattggtgcaaccgccggcgcgcgccggtgcaggccgaccatctctctcttccccccctccccctcccccgagccctcaaagagggtgtggcctaactagcggaaggcgtatttaaccagactagggcggcgggtccgccgtagtccttggctcgggtagccactgctctgtggctcgggtcccccggcccccctaacccccatccggtccgcgtcatccgccccctccgcctgcgacacaaacggccgcgcctccgggcccggtgacacgacgcgcctcgtctctgcggattgtcccgggagcgtcgcggcatggctcatcttcccggcggtgcggccgccgcccccctttcggaggacgcgatcccgtcgccgcgcgagcggacggaagactggccgccctgccagatagtgctgcagggcgccgagctgaacgggatcctgcaggcctttgcgccgcttcgcacgagccttttggactcgctcctggtcgtgggcgaccgaggcatccttgtacataacgcgattttcggcgagcaggtgtttctgcccctcgaccattcgcagttcagtcgctatcgatggggcggacccaccgcggcgttcctgtctctcgtggaccagaagcgatccctgctgagcgtgtttcgcgccaaccagtaccctgacctgcggcgggtggagctgacggtcacgggccaggccccgtttcgcacgctggtgcagcgcatatggacgaccgcgtccgacggagaggccgtggagcttgccagcgagacgctcatgaaacgcgagttgacgagcttcgcggtactactcccccagggcgaccccgacgtccagctgcgcctcacgaagccccagctcacgaaggtggtgaacgccgtcggggacgagaccgccaaacccaccacgttcgagctcggccccaacggcaagttttccgtgtttaacgcgcgcacctgcgtcacctttgccgcccgcgaggagggcgcgtcgtccagcaccagcgcccaggtccagattctgaccagcgcgctgaagaaggcgggccaagcggccgccaacgccaagacggtctacggggaaaacacacaccgcacattctcggtggtcgtcgacgactgcagcatgcgggcggtcctccggcggctccaggtcggcggggggaccctcaagttcttcctcacggccgacgtccccagcgtgtgtgtcaccgccaccggccccaacgcggtgtcggcggtgtttcttttaaaaccccagcgggtctgcctgaactggctcggccggagcccgggttcctcgaccgggagcttggcgtcccaggactctcgggccggcccgaccgacagccaggactcctcctccgagccggacgcgggcgaccgcggcgccccagaagaagaaggcctcgagggccaggcccgggtaccgcccgcgttcccggaaccgccgggaaccaagcggaggcaccccggggccgaagttgtccccgcggacgacgccaccaagcgcccgaagacgggcgtgcccgccgcccccacgcgagccgagtcgccccccctctccgcgagatacggacccgaggcggcggagggtggtggggacggcggccgctacgcgtgctactttcgcgacctccagaccggcgacgcgagccccagccccctctccgccttccggggtccccaaagacccccatacggctttgggttgccctgacggcaacgggtggtggccgaacgcctcaccgcgcccgggcacgcggggtgcgttgtgttaaaaaaataaataaatggggtagtgtgtcccccccccctccaaccaatatggctgtcgtgtgtggttccgggttgcgcctccgtcctttccaccccccttccccctccttttttgttttgcgtgcgcttataagagcgggcccggggcccttcgcagcttcaccgagagcgccgtcgggccccgggtgcgggatgtgtcgcggggacagccccggggtcgcgggcgggagcggcgaacactgcctcggaggggatgatggggacgacgggcgcccccgcctcgcctgcgtgggtgccatcgctcgggggttcgcgcatctctggctccaggccgccacgctgggcttcgtggggtctgtcgttctgtcgcgcggcccgtatgcggacgccatgtcgggggcgttcgtgatcgggagcaccggcctggggttcctccgcgccccccccgcgttcgcccggccgccgacgcgtgtgtgcgcgtggctgaggctggtcggcgggggagcggccgtggccctgtggagcctcggggaggccggcgcgcctccgggggttccgggcccggcgacccagtgcctggcgctcggggccgcctacgcggcgctgctggtgctggccgacgacgtccatccccttttcctcctcgccccgcggcccctgtttgtcggcaccctgggggttgtcgtcggcgggctgacgataggcggcagtgcgcgctactggtggatcgacccccgcgccgccgcggccctgacggcggcggtggtggcgggcctcgggacaaccgccgccggggacagcttttccaaggcctgtccccgccaccgccgcttttgcgtcgtctccgcggtcgagtctcccccgccccgatacgccccggaggacgccgagcggccaacagaccacggacccctgttaccgtcgacgcaccaccagcgatctccgcgggtctgcggcgacggggccgcacggcccgaaaacatctgggttcccgtggtgacctttgcgggcgcgctcgcgctggccgcctgcgccgcgcgagggtctgacgcggctccgtcaggcccggtcctgccgctgtggccccaggtgtttgtcgggggccacgcggcggcgggcctgacggagctgtgtcagaccctcgcgccccgggacctcacggacccgctgctgtttgcgtacgtcggattccaggtcgtgaaccacgggctgatgtttgtggtccccgacatcgccgtatacgcgatgctggggggcgccgtgtggatctcgctgacgcaggtgcttgggctccggcgccgccttcacaaggacccagacgccgggccctgggcggccgcgaccctgcggggcctctttttctccgtctacgcattggggtttgcggcgggggtgctggtgcggccgcggatggcggcgagccggcggtcggggtgatcgccatttcaaataaaaggcacgagttccccgaataccaccggcgtgtgatgatttcgccctaccgctccgatccccggggggaggggggaaggaaatgggggcgggggtgccgtggacgggtataaaggccaggggggcaggcgggcccatcactgttagggtgttaggttgggaggtggcacaaaaagcgacactcccgtgttgtagttgtccgcgggaggcggtggtttccggcaaccctcctcgctgcgccgggcgcgcccaccggtccttcgcgggggccggggctcttctggtcatggcccttggacgggtgggcctagccgtgggcctgtggggcctgctgtgggtgggtgtggtcgtggtgctggccaatgcctcccccggacgcacgataacggtgggcccgcgggggaacgcgagcaatgccgccccctccgcgtccccgcggaacgcatccgccccccgaaccacacccacgcccccccaaccccgcaaggcgacgaaaagtaaggcctccaccgccaaaccggccccgccccccaagaccgggcccccgaagacatcctcggagcccgtgcgatgcaaccgccacgacccgctggcccggtacggctcgcgggtgcaaatccgatgccggtttcccaactccacccgcacggagttccgcctccagatctggcgttatgccacggcgacggacgccgagatcggaacggcgcctagcttagaggaggtgatggtaaacgtgtcggccccgcccgggggccaactggtgtatgacagcgcccccaaccgaacggacccgcacgtgatctgggcggagggcgccggcccgggcgccagcccgcggctgtactcggtcgtcgggccgctgggtcggcagcggctcatcatcgaagagctgaccctggagacccagggcatgtactactgggtgtggggccggacggaccgcccgtccgcgtacgggacctgggtgcgcgttcgcgtgttccgccctccgtcgctgaccatccacccccacgcggtgctggagggccagccgtttaaggcgacgtgcacggccgccacctactacccgggcaaccgcgcggagttcgtctggttcgaggacggtcgccgggtgttcgatccggcccagatacacacgcagacgcaggagaaccccgacggcttttccaccgtctccaccgtgacctccgcggccgtcggcggccagggccccccgcgcaccttcacctgccagctgacgtggcaccgcgactccgtgtcgttctctcggcgcaacgccagcggcacggcatcggtgctgccgcggccaaccatcaccatggagtttacgggcgaccatgcggtctgcacggccggctgtgtgcccgagggggtgacgtttgcctggttcctgggggacgactcctcgccggcggagaaggtggccgtcgcgtcccagacatcgtgcgggcgccccggcaccgccacgatccgctccaccctgccggtctcgtacgagcagaccgagtacatctgccggctggcgggatacccggacggaattccggtcctagagcaccacggcagccaccagcccccgccgcgggaccccaccgagcggcaggtgatccgggcggtggagggggcggggatcggagtggctgtccttgtcgcggtggttctggccgggaccgcggtagtgtacctcacccacgcctcctcggtgcgctatcgtcggctgcggtaactccggggccgggcccggccgccggttgtcttcttttccaccccttccgtcccccgtacccaccacaccccaccccacccccccgccgtcccccgggcgttataagccgccgcactcgcttttcccaccggaaaatcctcggcccgatccgaacggcgcacgccgcgtgggctccaaacgcctccggaagagagcgccccgccccgatattcaagcccgcggtggtgctatggctttccgtgcttcgggacccgcctaccagcccctcgcccccgcggcctccccggcgcgggctcgtgttccggccgtggcctggatcggcgtcggagcgatcgtcggggcctttgcgctcgtcgccgcgttggttctcgtaccccctcggtcctcgtggggactctcgccgtgcgacagcggctggcaggaattcaacgcgggatgcgtcgcgtgggaccccacccccgtcgagcacgagcaggcggtcggcggctgcagcgcgccggccacccttatcccccgtgcggccgccaagcacctggccgctctgacacgcgtccaggcggagagatcgtcgggttactggtgggtgaacggagacggcatccggacctgtctgagactcgtcgacagcgtcagtggcatcgacgagttttgcgaggagctcgcgatccgcatatgctactacccacgaagccccggcgggtttgtccgcttcgtaacttcgatacgtaacgccctggggttgccgtgaggcgcgcgtccgacggtcccgcttctcgcctctcttcttcccccaccccacccaccgaccaacgacggcgtttggccaataccctccttttttctttttctcttccccccccccccaaaaaaaacaataaacagctaattgcgtacgacaaaccatgcggaactcgctgttttttttctctgtttgttactttttattgaaacagacatacggggaaaggggccggaaaccgagacggtggggccggcggtcgcatttttttaatggctctggtgtcggccgcgtttgagcttcgtcaacagggcgctgagggcggcgacgttcgtcgggccgtcgttggccagcgcgttggtccgggggcgggcgggcatgggcgacaggcttagtcccgggtccggggcgcgtgtggcccccggaggggagaagagggcagacccgccccagtcgtacaggggattttccgcctcgatgtacggggagtccggggcgtctcccggcagggcggccccgccggcaagacgccggcgagggcagatgttttcgtatacccgaacccaggggatctcctcgtagacgcgccccccatcctcgcccaccgactcgtaaatggaatctgcgtcctcggagggggcgcggggggcgtggctttcggccggccaggcggcggcggcggtggtgtcggcggcgggggtggcgccaagcccgacgcccgcgggcatggcggcgtcatcgtcgggcagcagatacgtgttttccatctggtccggttcggcctccgcgtccggcccccaggtccgcaccgcgtcgtagaccccggcggcctcgcgctgagccgcgagcgggcgcgccgcggctgccggccgctgctcggggggcgcggggttgcggggcgggaggcgcgggggcgccccggccatatgcgtgtaatacgtggccggccggccggcgcagggctcgggaccccggtcggccgcgtcgacgtgcgggggctcggggaggtcctcgcggtggcgcctgaacctccgaggggccgcgggggtcgagtgggggcgagcccgggggagcggcgggggtgcgttgtcgcgccgggtccgttgtatcttgtcccggcagctcccgccgaccgcgccgcggccccccggtgggccggacgccgcgaggcgcaggatggactcgtagtggggcgacggggttccgctccgaagcaggtccggggccagggcggccccgaaccaggacttgatgctgagttccatccgggcccagctcggggcggtcatcgtggggaacaggggggcggcggtcctgcagaagcgctcctggctgtccaccgccgcccgtaggtactcgttgttcaggctgtcggaggcccagacgacatacccggtaagcgtcgcgttaattatatactgggcgtggtggtggactatggatagaacctcgacggtcgagacgatggcgtccacgatcccgtacgtgccgccgctgcgcttgccggtctcccacaggtgggccaggcgcgtcaggtggcccaggacgtcgctgaccgccgcccgcagggccatgcactgcatcgagcccgtggtgccgctgggcccgcggtccaggtggcgcgcaaacgtctccgcgggcgcctccagactcccgctgagcgccacgaaccggcgatcggcggggcccaggcggcgacacacgtacttgtccgccgtccacagcatccacgaggcccaatggtacaacacggagacgtaggccaggagctcgctcagccgcagtgcggtgtccgtgctcggccggctcgggtctgcggggcgcataaagaacatgtactgctggagcctgtgggccgcgtcgcgcaaccccgccaccgcggcggcgtacttggccgcggcggccccgctcttgaacggggcgcgcaccagcagcttcgggagcagggtgggccgcagcagcacgtgcaggctggggtcgcagtcgcccgccgggtcgtcggggatgtccaggccgctgggcacgaccgtctggaggtacttccagtactgcgctaggatggcgcggctcagctggccgcccgacagctccacctcgccgagcgcctgcttggcggccgacgcgtagtgccggatgtagtcgtagtgcgggtcgctggcgagcccgtctacgatcaggctctcggggacggtgttatggtgccgcgccgccagccggacgctgcgatcggcgccggtcagaaacgccggctgcaggtcgtcggcgcgctgccgcaggacgcccacggccgcgctgaggagcccctccggggtggggagcagacacccggcgaagatgcgccgctcggggacgcccgcgttggcgccgcggatgaggttggccggcgtcaggcaccgcgccagccgcagggagctcgcgccgcgcgcccggcgttgcatggcggagaccgttcggtcgggggccccgccggtcggaggtatgccgcgtcccgggatatagggttgctttttatggggaggcgcctatgggcgtggcgggccgcccagcccggtcgcgcgcctcccggacacgtgcgcccggagggcggcggtctcctcgtcgcccatgagcagtttccgaaactgcgccatgatgtccacgacgcggacccgcggccccagcacggactcgctattcaggggggcgggggggaaggccgccaggtcttcgagcaggaaggcggggtctgccgtcccgctcacgggcgcccggggcgccgaggacgcggggcgaaggtccacgtgttccgcggcggcgcgcacgtccgcccaaaatttggcgggggtggtccgcgcgtacaggggctgggtcgcgcggaggacgcacgcgtagcgcaggggggtgtacgtgcccacctcgggggccgtcgacccgccgtcaaacgcggccagggccacgcacgcgaccaccgtgtcggccaggcccagcagccgctgcaggatgagccccgtcgccagcacggcgcgcgcggccgccgcgtcgtccctgcgccggcgcgcgtccccgcaggccagggcgtatttcagggtaacggtcgccagggccgtgtgcagcgcgtacacggccgcgcccagcacggcgttcagcccgctggtggcgagcaggcggcgcgccgcggtgtcgcccagcgcctcgtgctcggccgccacgaccccggggctgcccaggggcagggcgcgaaacagcgcctcctgctccacgtccgcaaacgcggggtgggcggagtgcgggtgcaggcgcgcccccacgaccaccgagagccactggaccgtctgctccgccaggaccgccagcacgtccaggacgcgccccgcaaacgcggcctcccgcgggagcacgcatttgacggcgccggggttgaagcgggcgagcagagccccggtggcgatgtacgtcatgcgccccgcgtagcgggcggccacgcgacagtcgcgccccaggagcgcgcgcaccccgggccagtacagcagggaccccagcgaactgcgaaagaccgcggcgtcggggccggggtgggggggcgcggcccctcccgcgctgagcagcggcacggcggcggcccccacgggccgcaacgccgtgaggctcgcgaactgccgtcggagctcggccgccctgtcgtcgagctccgagccgcgcccctccgtgtgcaggcgcgtcccgcagacccacccgttgatcgccacccgcacgatggcgtccaccagaaagcccatcgcgcgggaggggctggtttttgcccgccgatccgtcaggtcgaggatcgcgtcgcccgtgacgtaccaggccagcgcctcgccctgctgcagcgtctggcggaaaaacacctttgggtcggccggggaggcaaagtgcatgacccccacgcgcgacagcccgaacgcgctatccggacacgggtagaacccggccggatgtcccagggccagggccgagcgcacggactcgtcccacgcggcgactcggggggtcaggcggtccagggggaatgccgcctgcagctccgggcccgacacgcggcccgcgagaatctcgaccgtcgcggaaggccgcgccccggcgccgtcatcgtgcgcgacggcggcggggtagtcgtcctcctcgtagttgagctcgtccaggaacagcggcgagggcaccacccgcgaaccgcccacccgccccaaaacgtcgcgtgggtccatcgggcccaggtagcctccccgcggggcccgcgtgatggcgctgtcccggcgtccgcgaacggactggctcctggccgtaacggacctggggcgcggaaaggacgcccggcgggggggcgccgccgcccgggcctcggacgcgcgtcgggacccggggtgaccgcgggcctcccggcgacggcgcgggggcggctcttcgctcgccatctcccccgcggcctcgacctcgctgtcgtcgtccacgttaaacaccgcccgcaggtaccccattaacccgactccaccgccctcgggctcgtcctccacgggcgagtcggcgcgatgcgcggacggggcatgggaccgggtggaggcgcgcctccggcgtacggcatgcccgcgcacggacatggtggccggaggcccgattttttacacacgccctccccgcagacggacgaggaaaggggtggtgcgaggggggaggcccaaacggggaggtggggggtagggggcggtcccagggagcggggggtaggaaccggcacgacgggaacagagaaaacgcgaccgctccaacaagggtgggggggtgggcctcgtccccacgcagacccgcgggcaaatgcgagaacgggacccgcgcgcctgcctttatacgcggaccccagcaccacgagccgttctgtgacgcgaatctacacgaccgcgggctcgtaggcgcgactaacgcccaacccaacggcacacaccccccaccccgcgcgtaaccccatttctttcatggtcccgtaataaacagccaacgcacgccgcgtatgatgagttgcttgccaatgtttattgctgtggttgcgaaccctctatcgcgatacagacggaggtgaggcggggcggtggtgggggggggcgcgccgcccggtcgcacatcctaccccccaaagtcgtcaatgcccatggcatcggtaaacatctgttcaaactcaaaatcgtccacgtccaaagccccatacgagacggggtcgtgggtcattcccggggagggggactccacgtcccccagcatctccaagtcgaagtcgtccagggcgtcggcgggcgtcatatccacctcctcgccgtccaggcggagttcgtctcccaggctgacgtcggtaatgggggcggtggtggacagtctgcgggggcgttgtcccgcggagagaaacgacatgcgcggcgccaccagcccggcctccgcgggagcgtcatcgtcgtccgggaggtcgagcaggccctcgattgtcgatccgtaattgtttctggtccgcccgcggctatacgcgtgctcccgcatgacggactcgccctccgaggtcgcgacgctggagtacgagtccaacttggcccggatcagcagcataaagtacccagaggagcgggcctggttgccctgcaggacgggcggggtcgtgaggggcgccccgggttcctccgccgccgcacttcgcaccagcgggaggttcaggtgctcgcgaatgtggtttagctcccgcagtcgccgggcctccacgggaactccccgcacggtgagcgatccgttgataaacatcaggggctgaaacagacacgccaactggcgccagctctccaggtcgcagcagaggccgtcgaacagatcgggccgcatcatctgctcggcgtacgcggcccataggatctcgcggctcagaaagaggtatagatgcagaaacaggacgcgcgccaggcgcgcggtctcgcggtagtacctgtccgcgatcgtggtgcgcagcatctcccgcaggtcgcggttgcggccccgcatgtgtgcctggcggtgtagctgccgaacgctggcgcgcaggtaccggtacagggccgagcaaaaatttgccaacacggtccggtagctctcctcccgcgcccgcagctcaccgcggaaaaactgcgccatggcctcgtagtacgaaggcagctcgtcgcgggtggcgggcagggtggggaacgccacgtcgccgtgggcgcgaatgtcgatcggggagcgctcggggacgtgcgcatccccccagtcgatcacgtcgctgggcagcgtcgacagaaacttgcactcccggtacatgtcggcgttggtcgggaacccagagaacaggtcctcgttccaggtatctagcatggtacacagcgcgggacccgcgctgaagcccagatcgtcgaggagacggttaaacagggccgcgggggggacgggcatgggcggcgagggcatcagctgggcctgactcagccgaccggtggcgtacagcggaggggcggctggggtgttcttgggacccccggctggcctggggggcggtggcgaaaccccgtccgcgtccgcaaacagatcgtcgaccaacaggtccatgggggcggttgggtccgggaataacgatctcgagaggcgaatgagacgtgcccgagcgcccggcggcggagagggggggagggatccgggacccgcgacagaaaaaggccggggccctcgcgaagggaatcgccgggggtgccgtgcgtccccgaggactgacatctcgcgtccaccaccccgcatttaagtatcaccccagtgccgccccaaacctcgtgacttccccaccgctccgggcggcccgtcccccgcgctcggaagggaggcgtgtccttcctcccgcccctcccgcccctcccgcccctcccgcccctcccgcccctcccgcccctcccgcccctcccgcccctcccgcccctcccgcccctcccgcccctcccgcccctcccgcccctcgccacaaacgcgtgctgacagcgaagtggttaaatcgaccgtgatgctttattgtctgtcgtctgaacgcggtcggggtcgctactcgagggggcggcggggacgggaagccgagcgggcgggggcccgtgcggtcgcggcggcacgccccgcggggcggccccgggcggccgcggtcgcgtcgacgtcctgcgccgcgtcgggattcaccaactcgttcgcgcgctgcaggaggttcttgccctcgcagaccgtcacgcgaatggtggtgaggtcgaggagctcgttgaggtcttcgtcggtgtgcggccgcgacatgtcccacagctgtaccgccgccagccgggcgtgcgtggccgccaggcgcccgaccgcggcgcagaagacgcgcttgttgaacccggccacccggggggtccacggcgccgtggggctcggtggggcggtgctgaagtgcagcttcttggccagtccctgggcgggtgtcttggttcttcccgaggccgtgggagcgggggcgtctaggagcacggcggagtcggcctgggcgggtcgcctgccgcgggcggggtcggtcgccggggtcgcggaggccttaggcgccccgcgcgtcattttgggggtccgcgcgggaggggcgtgcgagcgcccgccggcgcccacggggcccccggggggtggaggagcgcgcgcggggccggggccgtgagagcccgcgacggacgccgaacgacgcggtcgcgcggtatcccgggactcgtcgtcgtccgaagacgagtcccggtagagggcatacccagcctcgtcataatggagaaagcgaacctcgcccctcgggcgcgcgcgcatcgggccagcgccgcggcggaagtcgtcgcgcggactctctgggtccgccggggagaccgggccatagtacagctcctcgtgggtcccgcgcggcgcttcccgcggacacgacttgacggagcggcgagaggtcatggtctatcggagacaccggggacgcccgtgcggatcacagggaaggcgtcggcgaaggaggcagagagcgtcggaaggcggcgagggagggaaagagggagaccggcggggtacgggagagcagcgagggcctgcgtaacccacgggggccgcgggagtggctccctgcgggttgcgggggagagtttataggaagtggatataaccgcaggcgacgggactaaccaatccccgggggggcaacggacagacacgccccgaacaggcccgacttccgcgaggaagcaaaggccgggggccgcccaacgacacgcccaccccttcccaacagggcgggctcaggctgacccggcggccagtgcccgctgacatatctgatacacgtgcgcgatcatacatacgcccatcgaggtcatgcctagataaaagggcaccaggacccccgggacggacaccacaccggcgctgtcgccccggcattgcgcgtccccgataacgccgcgtgcgcctgccgcgttcggcggctccccgggcacgcccgcgacgagcgcgacgaacaacagcaccacccagcggcccagtcttgcgggtttccccgtcatcgcggcgatgagtcagtgggggcccagggcgatccttgtccagacggacagcaccaaccggaatgccgatggggactggcaagcggccgtagctattcgcgggggcggagtcgttcaactgaacatggtcaacaaacgcgccgtggattttaccccggcagaatgcggggactccgaatgggccgtgggccgcgtctctctgggcctgcgaatggcaatgccgcgggacttctgcgcgattattcacgcccccgcggtatccggccccgggccccacgtgatgctcggtctcgtcgactcgggctaccgcggaaccgtcctggccgtggtcgtagccccgaacgggacgcgcgggtttgcccccggggccctccgggtcgacgtgacgtttctggacatccgggccacccccccgaccctcaccgagccgagctccctgcaccggtttccgcagttggcgccgtccccgctggcagggttacgagaagatccttggttggacggggcgctcgcgaccgccgggggggcggtggccctgccggccagacggcgcgggggatcgctggtctacgcgggcgagctaacgcaggtgaccaccgagcacggcgactgcgtgcacgaggcgcccgcctttctgccaaagcgcgaggaggacgcaggctttgacattctcatccaccgagccgtgaccgtcccggccaacggcgccacggtcatacagccgtccctccgcgtattgcgcgcggccgacggaccagaggcctgctatgtgctggggcggtcgtcgctcaatgccaggggcctcctggtcatgcctacgcgctggccctccgggcacgcctgtgcgtttgttgtatgtaacctgaccggagtcccggtgaccctacaagccgggtccaaggtcgcccagctgctcgtcgcggggacccacgccctcccctggatcccccccgacaacatccacgaggacggcgcattccgggcctaccccagaggggttccggacgcgaccgccaccccccgagacccgccgattttggtgtttacgaacgagtttgacgcggacgcccccccaagcaagcggggggccggggggtttggctccactggcatctagaccgcgcctcgcgtcgggccagatggggccccggtcaataaagagctctgtttcgcatatgccctggtgttggcggttttttttgttgtctgtctgcccggcgctcggttgtccgttctgtcgtcgctatcacatacgcacaaacacacgggtagagtggaaccgaaaccggtcgacgtttattcaccacacagaaacacaagctaagcgagaaggaggggggcctcggtcgacgaggcctggcgtttgggggcggacgtgcgatgacgtgggtccggtgtagggtccgcggggggcacgggcccggggcgaacgggggatctgtcgccggcgtgggtgactgggaccgacgcaacctccggggcttgtgccctcgtaggcccggggggggcctcggtcgctccaagccccgcggtgcgggtccctccggccagagccgaggtggagagaccaagggcccgctccgcgatcgccacgtcctccatgaccacgtcgctctcggccatgctccgaatggcctgggagacgagcacgtccgccgacttgtccgcggcccccaccgacatgtacatctgcaggatggtggccatgcacgtgtccgccaggcggcgcatcttgtcccgatgcgccgcaacggccccgtcgatggtggagccctcgagtcccgggtggtggcgcgccagcctctcgaggttgaccatgcaggcgtggtatgtgcgggccagggcgcgcgccttcacgaggcgccgggtgtcgtccagcgactctagggcgtcgtcgagcgtgatgggggcgggcaaaagcgcattgaccaccgccagggcctcctgcagccgcggctccgcctccgagggcggagccgcggcccgaatcatctcatattgttgttcctcggggcgcgttccccaaccgcacagcaccccgagcagggacgccatcccggaacacgcgcgcggctctgcgccggctttcccccaccccaccccctccgggttcgcaggggcgatggggacggaagactgcgatcacgaagggcggtcggttgcggctcccgtggaggttacggcgctgtatgcgaccgacgggtgcgttatcacctcctcgctcgccctcctcacaaactgcctgctgggggccgagccgttgtatatattcagctacgacgcgtaccggtccgatgcgcccaatggccccacgggcgcgcccaccgaacaggagaggttcgaggggagccgggcgctctaccgggatgcgggggggctaaatggcgattcatttcgggtgaccttttgtttattggggacggaagtgggcgtgacccaccacccgaaagggcgcacccggcccatgtttgtgtgccgcttcgagcgagcggacgacgtcgccgtgctccaagacgccctgggccgcgggaccccattgctcccggcccacgtcacagcaactctggacttggaggcgacgtttgcgctccacgctaacatcatcatggctctcaccgtggccatcgtccacaacgcccccgcccgcatcggcagcggcagcaccgcccccctgtatgagcccggcgaatcgatgcgctcggtcgtcgggcgcatgtccctggggcagcgcggcctcaccacgctgttcgtgcaccacgaggcgcgcgtgctggcggcgtaccgccgggcgtattatgggagcgcccaaagccccttttggtttctgagcaaattcggcccggacgaaaagagcctggtgctggccgctaggtactacctactccaggctccgcgcttggggggcgccggagccacgtacgatctgcaggccgtgaaagacatctgcgcgacctacgcaatcccccacgacccacgccccgacaccctcagtgccgcgtccttgacctcgttcgccgccatcactcggttctgttgcacgagccagtactcccgcggggccgcggccgctgggtttccgctgtatgtggagcgccgcatcgccgccgacgtacgcgagaccggcgcgctggagaagttcatcgcccacgatcgcagctgcctgcgcgtgtccgaccgggaattcattacgtacatctacctggcccactttgagtgcttcagccccccgcgcctggccacgcatctccgggccgtgaccacccacgaccccagccccgcggccagcacggagcagccctcgcccctgggtcgggaggcggtggaacagttcttccggcacgtgcgcgcccagctgaacatccgcgagtacgtaaagcaaaacgtcacccccagggaaaccgccctggcgggagacgcggccgccgcctacctgcgcgcgcgcacgtatgccccggcggccctcacgcccgcccccgcgtactgcggggtcgcagactcgtccaccaaaatgatgggacgtctggcggaagcagaaaggctcctagtcccccacggctggcccgcgttcgcaccaacaacccccggggacgacgcggggggcggcactgccgccccccagacctgcggaatcgtcaagcgcctcctcaagctggccgccacggagcagcagggcacgacgcccccggcgatcgcggctctcatgcaggacgcgtcggtccaaacccccctgcccgtgtacaggattaccatgtccccgaccggccaggcgtttgccgcggcggcgcgggacgactgggcccgcgtgacgcgggacgcgcgcccgccggaagcgaccgtggtcgcggacgcggcggcggcgcccgagcccggcgcgctcggccggcggctcacgcgccgcatttgcgcccggggccccgcgctccccccgggcggcctggccgtcgggggccagatgtacgtgaaccgcaacgagatcttcaacgccgcgctggccgttacgaacatcatcctggatctggacatcgccctgaaggagcccgtcccctttccccggctccacgaggccctgggtcactttaggcgcggggcgctggcggcggttcagctgttgtttcccgcggcccgcgtagaccccgacgcctatccctgttattttttcaaaagcgcctgtcggccccgcgcgccgcccgtctgtgcgggcgacgggccctcggccggtggcgacgacggcgacggggactggttccccgacgccggtggtcccggcgacgaggagtgggaggaggacacggaccccatggacacgacccacggccccctcccggacgacgaggccgcgtacctcgacctgctacacgaacagataccagcggcgacgcccagcgaaccggactccgtcgtgtgttcctgcgccgacaagatcgggctgcgcgtgtgcctaccggtccccgccccgtacgttgtgcacggctccctgacgatgcgtggggtggcgagggtgatccagcaggcggtgctgttggaccgcgacttcgtggaggccgtagggagccacgtaaagaactttttgctgatcgatacgggcgtgtacgcccacggccacagcctgcgcttgccgtatttcgccaagatcggccccgacggctccgcgtgcggccggttattgcccgtcttcgtgatcccccccgcgtgcgaggacgttccggcgttcgtcgccgcgcacgccgacccgcggcgcttccactttcacgccccgcccatgttttccgcggccccgcgggagatccgcgtcctccacagcctgggcggggactatgtcagctttttcgagaagaaggcgtcgcgcaacgccctggagcactttgggcgacgcgagaccctgacggaggttctgggccgctacgatgtgcggcccgacgccggggagaccgtggaggggttcgcgtcagaactgctggggcgaatagtcgcgtgcatcgaggctcactttcccgagcacgcgcgggaatatcaggccgtgtccgttcgccgggccgtcattaaggacgactgggtcctgctgcagctgatccccggccgcggcgccctgaaccaaagcctctcgtgtctgcgcttcaagcacggcagggcaagtcgcgcgacggcccggacctttctcgcgctgagcgtcgggaccaacaaccgcctatgcgcgtccctgtgtcagcagtgctttgccactaaatgcgataacaaccgcctgcacacgctgtttaccgtcgatgcgggcacgccatgctcgcggtccgctccctccagcacctcacgaccgtcatcttcataacggcctacggcctcgtgctcgcgtggtacatcgtctttggtgccagtccgctccaccgatgtatttacgcggtgcgccccgccggggcgcacaacgataccgccctcgtgtggatgaagataaaccagacgctgttgtttctgggcccgccgaccgccccccccggcggggcatggaccccccacgcccgcgtctgctacgccaatatcatcgaaggtcgggccgtgtccctcccggccatccccggcgccatgagccgccgggtcatgaacgtgcacgaggccgtaaactgcttggaggccctctgggacacccagatgcgcctggtggtcgtcggttggtttctgtatctagcgttcgtcgcccttcaccaacgacgatgcatgttcggcgtcgtgagtcccgcgcacagcatggtggccccggcgacctatcttttgaactacgccggccgcatagtgtcgagcgtgttcttgcaatacccctacacgaaaatcacccgcctcctctgcgagctatccgttcaacgccagaccctggtgcagctgttcgaggcggatccggtcaccttcttgtaccaccgcccggccgttggcgtcatcgtgggctgcgagctgctgctccgcttcgtggccctcggtctcatcgtcggcaccgctctcatctcccggggcgcctgcgcgatcacacaccccctgtttctaacaatcaccacctggtgtttcgtgtccatcatcgccctgacggagctgtatttcatcctgcggcggggctcggcccccaaaaacgcggaaccagcggcccccagggggcgctccaaagggtggtcgggcgtctgcgggcgctgctgttccatcatcctctccggtatcgccgtgcgcctgtgctatatcgccgtcgtggccggggtggtgctcgtggcgcttcgctacgaacaggagattcagcggcgcctgtttgatctgtgacgtaacgcctcttccgttggaagaggcggacccagtcgcccatgcaaattaaatacacgacccgcctcgggcctacgcaccctcgcacgtcgcatgcaaattaaaatcgtgcacagagccgatccggcctcgggtctgcttgcccctcccccggcccagcacaggcaggctcgtccgacttccgcatacaccccaccctaccgcgtgcttccgcacccccgcctacgcgtgtacgcgaaggcggacccagacctgccgtatgctaattaaatacataaaacccaccctcggtgtccgattggtttctggggacggcgggggcgggggcggtgacgcccgacggggagggacaaggaggagtttcggaaagccggccccggtcgtgcgggtataagggcagccaccggcccactgggcgctgtgtgctgccgtgtgccgaccccggttgcgcgtcggtgccgctcctcgattcggacccggccactctcttccgacacgcgccccctcggaggacacccgccatcccagccccggcgacctacaacatggctaccgacattgatatgctaatcgacctaggattggacctgtccgacagcgagctcgaggaggacgctctggagcgggacgaggagggccgccgcgacgaccccgagtccgacagcagcggggagtgttcctcgtcggacgaggacatggaagacccctgcggagacggaggggcggaggccatcgacgcggcgattcccaaaggtcccccggcccgccccgaggacgccggcacccccgaagcctcgacgcctcgcccggcagcgcggcggggagccgacgatccgccacccgcgaccaccggcgtgtggtcgcgcctcgggaccaggcggtcggcttccccccgggaaccgcacggggggaaggtggcccgcatccaacccccgtcgaccaaggcaccgcatccccgaggcgggcggcgaggtcgccgccggggccggggtcgatacggccccggcggcgccgactccacaccaaacccccgccggcgcgtctccagaaacgcccacaaccaagggggtcgccaccccgcgtcggcgcggacggacggccccggcgccacccacggcgaggcgcggcgcggaggggagcagctcgacgtctccgggggcccgcggccacgaggcacgcgccaggccccccctccgctgatggcgctgtccctgacccccccgcacgcggacggccgcgccccggtcccggagcgaaaggcgccctctgccgacaccatcgaccccgccgttcgggcggttctgcgatccatatccgagcgcgcggcggtcgagcgcatcagcgaaagctttggacgcagtgccctggtcatgcaagacccctttggcgggatgccgtttcccgccgcgaacagcccctgggctcccgtgctggccacccaagcgggggggtttgacgccgagacccgtcgggtttcctgggaaaccctggtcgctcacggcccgagcctctaccgcacattcgcagccaacccgcgggccgcgtcgacagccaaggccatgcgcgactgcgtgctgcgccaggaaaatctcatcgaggccctggcgtccgcggatgagacgctggcgtggtgcaagatgtgcattcaccacaatctgccgctccgcccccaggaccctatcatcggaacggcggccgccgtgctggaaaacctcgccacgcgcctgcgcccctttctgcagtgctacctgaaggcccgaggcctgtgcgggctggacgacctgtgctcgcggcgacgcctgtcggacattaaggatattgcctcctttgtgttggtcatcctggcccgcctcgccaaccgcgtcgagcgcggcgtgtcggagatcgactacacgaccgtgggggttggggccggcgagacgatgcacttttacatcccgggggcctgcatggcgggtctcattgaaatactggacacgcaccgccaggagtgttccagtcgcgtgtgcgagctgacggccagtcacactatcgcccccttatatgtgcacggcaaatacttctactgcaactccctattttaggcaagaataaacatattgacgtcaacccaagtggttccgtgtgatgttcttggcgcgcgcggcgggtggggcggagactccggggcgatgccggcgtgcgcgtgggaggagggcgatgacccaccggataaatgtggggccccggcccggcccgcttcatagcgcgtccaggaactcacggcagacgcgtattcaccgacccccccctcgcaacatgacaacgacgcccctctcgaacctgtttttacgggccccggacatcacccacgtcgcccccccgtactgtctgaatgccacgtggcaggccgaaaacgccctgcacacgaccaaaacggaccccgcgtgcctggccgcgcggagttatttagtccgcgcctcctgctcgaccagcggccccatccactgttttttctttgcggtgtacaaggactcgcagcactcccttccgctggttaccgagctccgcaacttcgcggacctggtcaaccacccgcccgtcttgcgcgaactagaggataagcgtggggggcggctgcggtgcacgggcccattcagctgcggaaccatcaaggacgtctccggtgcatcccccgcgggggaatacacgataaacggtatcgtgtaccactgtcactgtcggtatccgttctccaaaacctgctggctcggggcatccgcggccctacaacaccttcgctctataagctcaagcggcacggccgctcgcgcggcagaacagcgacgccacaaaatcaaaatcaaaatcaaggtataacccacccccttccctccgagtccgtatgcaacctcattaataaagagtgagaaccaaccaaaacagacgcggtgtgagtttgtgggttataggaacccggtaaataccacgcgacgaaccagcatgtgtgttaacgcaacttttattcgttgtatcgcgggaggggggaagcttaccgccaaaggaaggccaagatgataacgacgaccaccgcgaccaccccaaaaaccgcatgacgacacgtcccgccacaccaccctggggcttggggcgtgtcggagctcgacgcacagcgggccgcgcgttgggcccggtacagctctcgcgaattgacaagcgggggtcgccacgtgcgcgagctttgcacgcggggttggtcggccggccccacggacccgcccggtggctcggtcggacatgcggccatgaccatggcgtaggtgggggggcgatccgaggtcgcctctgcgtaagtagggaggcccgacgggaggtcgcctcccacgccagggtgggccccaatcatagtttccggtagaaacaggggggtctccacaaacaacccccctgggccaaagctccggcgccgcgcccgtcgttcggcgcggcgcctggcgcgccgagcggcccgccaggcggcgcggcgcgagcggccacgctcacacacctcgccgtcaccggaagaagccggtgaaacaagcccaaccggcgacgtccctgcagagtacggtggaggcgagtccgtgggggtgtcgatatcaataacgacaaactggcccgcgctcgcgccggccacactctcgtatgggggcggggcgtcaatcacgctatcatctccgtcatccctgcatgcgtgggcatgcccagcccccaacgccatggtggggattcgcggctcagaagcctgcatgtcgtgtggtcggtcgtagtccaacgtgcctcccccacccaccacacagccggtccccacgccgaccactagaccgcagacgtcgcccaaccgaggtccccgtgcacagaccgcgccttttatagccccaggggttgctaattaacgcacgcatgcagacgcaatttattttgctcccccgcgtcctcccctcccctgcgcacacgtgataggtcttgggaacccgaggggcgacgcggggaaagcgcgcccccgcccggccgccgcgcgcccccgcccggccgccgcgcgcccccgcccggccgccgcgcgcccccgcccggccgccgcgcgcccccgcccggccgccgcgcgcccccgcccggccgccgcgcgcccccgcccggccgcccgcgtcgcgccggcgccccctcccggcgcttccggggtctttccttccttccccgccgcgaccccggccccgccccaccgccccgcccggcaggggggccccggcgccgcgcagaacacacagacgaacacacggtggcgatcttttctttacttcggcggaccagcgagccccggccccggcccgcgccccgccgccacacccacggcaccccccccccgccgcccaccccggggtccacacaggagcgcgcgggcggcagaaacgcgggcgcggcggcggtcggggtgggagtggtggtgggggacacgaaaacacacccacgacactctccccccaccccgaccgccgccgcgccccaccggcgggatcgcggcgagacgcagccgggcccccccccaccacccgcccacccacctaccccgcgcccgcagcctccggcagcacgccgaccaccgccgccaccccccaaacagccaaggcgcggtggggggcgtggtggtgaacgatggggggaacacgggggggaggggtccggggcgaggcgggcgggcgaaggaagggggggtggtggcggcggcggtggaaagcggaaaaacggaggatggaagggcagaagatggggagtcccgatcctcctcctgcatcccctcgccttccattctccggccctccgcgagtcccgacgccccccccccgccgcccgacgaaggagacccaagcaccgcagccggagaggccgagcggggagtgggcggccgggcgggaggatggcggagagagagagagagagagagagagggggggggggggagagggaaagcaacgggaaagagaggcgcgcggaaaagcagcaagaggggggacggggcgagccgggcagagtgcggagcccccggagcccgcggccgcagccgagcagcgccgcgggctccggggccgggccgggccggcaacgccccgcgccggccgcggcggagagaacccctgtgtcattgtttacgtggccgcgggccagcagacgggccgcgggccagcagacgggccgcggcgccagcggcccacgcctcccgccgcattaggcccccgcgggcatccggcggccggccccacgcccttccattaaacactcccacgttgggggggggcgcgccagctgagtgctctgcggttgcgggcgccgtgcccggagatccattaagccgccggagagcccgagccccgcccgcgtgttgctgtgggcatttctgctgcgtcatccctgtctttataaaaccgggggcgcggcagcaacgaacgcaggggcccgccgccgatcgagagggactccggagaaggaaggctgctccgcgcaccggcgcgcccttctcctctcccctccctacctccccctctcttcccccttttttcccccgcctcccgtcttcttccgcgcctccgagggtccgcctctgcctcggggacccccgggcgggccggggcttggccgccgaggtgcgccccggccggaggggcccccgcacctcggcggccgccccctccggcgccgcgcgttcgcgaaaggcgcgaaaggggcccccggaggcttttttcgattcccggccgggggtcccgggtagccgcccggcgccgggcggaaggcgtcccccgcccggcggtccggcccgggcccccggcggagcgcgggggccccggggccccgggccgcgccggcggcgtttccgcgttccgtttcttctccctcccggccgccccgctcccgggcccgaccctcgccccttcccttctcctcgtcttcccccgtcccgccgcgccccttccctcttccttctctctctctgtctcgctctcctcacatttcccccccccccccgccgccgccgccctctgcccgcgtcccaccgagacgccgcgccgcgtgagccgtccgccgggggacccaggctccggggggggggggcgcctgcgtgtgtctcgtgtgagagagcgcgcccctcgaacgccgcgcgttctcgcaggtaggtttagggtcgtacaggtgagcttctgctgaggcggcgggagagggggggggggcgggcggaagagagaagagagcaggggttgggggagaactgttcttcctccccctttcaagaaacacgaggcgggggtcccagaaagggcaggcaggtcagccgcaccgcccgcgagccaacccgtatcctttttttctaggtgtttttgtttttgtttctgtttttgtttgttttgttattattttcgcggatccggcgtgttcggatccaccccccctttctccttcctcttcccttccacccacccccgtttcccccccccgtggtgtcgtccgggggcgtcgttcccagggggggcaggcgcgggtcgggcccatacgcccaccgcccccacgcgccggtcacccccccccaacaaccccaaaggcgcgtgcccagccacagccgtgggtgtggcgcccgtccccttcctctaccgcgtgggcgcgggcgggggggtggtggtagtggtggcggaaggaaacgggccgggggccggggccgctagggaaaggtaggcacgcgcgcggtgtgtcgacttgcatgccccgcaaaacgcgtcgtgtcgtgttgtgtcgtggtgggccgtgttgtggtgggccgtgtggtgtggtgtggtgttgcgaacgcgcgagccccctcgccccgatgggagtctccccgcagccagggtaaggaggggcgggcgtggcgggcaggtgtgcgggcggggtggggtgagtgcggttgcatgcctcgggtctcctcttcctgctcctcctcctttctcccagccagggtgaggaggggcgggcgtggcgggcaggtgtgcgggcggggtgggcgccggggcgggggtgggcacgggcgtaagtgcgggtgcatgcctcgggtcttctcttctccctcctccttcctcccacccgtccccgggggcagagggcgtgcatgcgttgtgattcaaccgccctcgcccccgccccactttccccccctctctatcaaagttccctggcccctggcttcgcgccggtggtgcggctgaccccccccctcctccctccccgagccaggcgccctcccactcctgcccaccacccccagggtctggccggccagacgtgcgtgctctgcacgatcgggcccccctccctgtcaacacggacacactctttttttacccgccagccagcccgcccacccaccaagacagggagccagaacgcaggccgggccccggctctgttctatcataaagaccaacaggcctcgggggtgggggcggcttctcgtgcccgccccccctcctcctcctccctttccccccccccatccccggcccccctgcgcgggggagctgcatcaaaggccaacaacaaagtgtgtcaaaagcatcacaaaactttattgtaaaatttttataaatataaagttttttttcctcaagttttcaacaaggccagaaagtccataacaaaatgctggtgtgtgttgctgttcggggccgtgtccgtccccccccactcccacccccacttcctgtctcctccccgtctttcccccccacctccccctgcccccgaggcgcctcggccggtggtccggtggggggcggcttccctttgggcagcaagccgagtgttagctccccctactccccgtggcccgcgggggcgtcgccggccggcgcgggcgcgccctgctcccgagaccacgggtggcgcgaccggaggccgtggaagtccagcgcgcccaccagggtgccctggtcaaagagcatgttgcccaccggggtcatccagaggctgttccactccgacgcggggggcgtcgggtagtcggggggcctcacgcagttgcgcgcgtgctcggggagcagggtgcggcggctccacgcgggggccgcggcccgcagcaggtccgccacgttccccgtctggtccacgaggaccacgtaggcccctatgtggcccgtctccatgtccaggacgggcaggcagtcccccgtgaccgtcttgttcacgtaaggcgccagggccacgacgctcgagacccccgcgatgggcaggtagcgcgtgaggccgggcgccgggtcgcgggccccgggctcggggccgccctccgcgtggcgcgtcttcctggcacacttcctcggcccccgcggcgcagcagcgcgggggccgagggaggtttctcgtctctccccagcgccggacgcggacgcgacgctcccaccagccccgcccgcagaggaagaggcggaggaggaggaggaggaagaggaggcggcggaggaggaagaggcggcggaggaggaagaggaggcggcggaggaggaagaggaggcggcggaggaggaagaggaggcggcggaggaggaagaggaggcggcggcggcgaccgcggcctgggacgacggagacgccgacgggggcgcggcgcccgcggacgccggggcgagcggcccgtggccgcggtcgcccgagtccgagtccggggcccggcgcggcgccgccctcttggcccccaccccctggggggcgaggggcgagcgcggggcggcggaggaagaggcggaggacgaggccgcagggcccgagtccgacccgcgcctcttccgggggcgggccgccgccccctccgcggcgtggggggcggcaccgggggtgttggtgccgcgggggaccccgggtcctccctccgcgcccggccctcccgacccgcgcgcgtcggtcgcgcctgcccggcccagactctgtgcttgggtgtcggtctgagcctgggtcatgcgcgaccggggcgcgcggtgcgcgtccaccggcacggcgggcggcgcgggcccggccgcgtccgcgctcgcagacaccacgggggcggcggcggcgcggggcggactccggacgcgcggggcgacggccgcgcgggggcgcgccgcgcgccccgacgactgtggcagacctccccccccggggcccgaggacacctgcgcggaggaggaggagaaaaaggagagcggcccggggcccgcggggcggcgcggagacggcgggggagagtcgctgatgactatggggggctcctgggccgcgcggggctgtcccgcggggggcgtcctgccctccgccgccgcggcgtcttcgcccacccgccgcgcctgcgcgcgccccccgccggccgcagggggaagagaggccactctcggcacgacggccgcgacggcagggccgcccccagacccagatcccacccccgcccgcaacggggcgccgccgctgctgctgctccgcggggcgccagggggcgccggtcgggtcgcggcgggctgggaggttccgcgggtcgcccccgcaccgccgcccccgcgccggggcgctcttcggggggcgggcgggacgtagtccactgcagagggagacagagacgggagcccccggttagtgcccgacccccgcccgacccccgcccgacccccgcccgacccccgcccgacccccgcccgacccccgcccgacccccgcccgacccccgcccgacccccgcccgacccccgcccgacccccgcccgacccccgcccgccctcaccgtcggccaggtcatcgtcctcgtcgtccgtgccgggccacgggggggtgggcgacagggcgcggaccgtgtgtccccccagcgacagggagcgcggggccgtccgctggttgcccgtccagataaagtccacggccgtgccggcccgcacggccgcctcggcctccacgcgggtccgggggtcgttcactatcgggatggtgctgaacgacccgctggcggtcacgcccactatcaggtacgccaccggggtgttgcacaggggacacgtgttgcgcaacggaatccaggtcttcatgcacgggatgcagaaggggtgcaggcagggaaaactctggcagcgcaggggcggggcgatctcgtccgtgcacacggcgcacacgtcgcccccccctcccgcttccgcttcctcctcacccacgggcccacccccgcaggatccctgcgcgtcggcgggcgtggggctgccctggcgctcggccgggggccgggccgggggcgtggccgcgtccatcaggcccgcctcgaacatctccgtgtccgtgctgcccgcctcggaggtggagtcgcggtgaaggtcgtcgtcagagattcccacctcggtctcctcctccgagtcgctgctggcgagccactgcatgtcgttgagcatcccccaggcgtgcggggcggcgggctgcttgacaaagcaacgggggggatttagagggcgcggggcgtgaggcgggacccccgcgccgtgtcccccgtgtccctccctcaccccggccccccgcccgctgctttttgttcggaagggggggagaaaggggtccgtaaccaaaggtggtctgcgtcctttggattccgacccctcgtctccccccctgtcccccgctctcgggctcctccctgcctccctcgcccccccagagggtcggggggcggcgcacggcccacgggggtcccccgaccgcttaagcgggccgggggtcggccccgtcaagcgtccccgcccccgagcccaccgcccgcgaccacccccaacccgcagccgggtggtccggggaaaagggggggcctgagacccgggggtcgccctctcaccgtgccgggggtctgccgcggcggccgctcggggccggggtccgcccgggagctcgtgccgggccggggttccatgagccggggtagggtagactcgagacggcggcccgcggtctctctcttgccgggttttagtctctgtctctccgggtctcctcctcccgccgggccgccgctccgtcgctcgcagtgccggggtgcgaatgcggcccgaccgtcacacggggctgccttatacccggcgcctatccactcccccaaaggggcggcatttacgattcccccaatagccgcgcgccccggcgggggcggagggagggaatccccccctctcggggcggccccgtccccggggaccaaccgggtgtactccaagaaccccattagcatgcgccgccccccgccgacgcagatgggagtccccccggcgccccgccggcgcggccctgagtggtgcccgcccccggggagaaattcattagcatactaggaagcccaggggaccaataggggccgatcagcccacccacccggcggcgcgcgaggctctgcgtgttctgccaagaaagtaatcagcataacccggaaccccgagggagtaattacgcggggagcgaggggccgtccgaacgtttttaattaccataagcgggaatggcggcccgttaaaagctgctaattaccgcgagcgggaacgccggcccattaaaagttgctaattaccatgcgcggggatggcggccgggaccgcctattaaaagtttctaattaccataccgggaagccggtctagaggatccccgggtaccgagctcgaattcatcgatgatcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggatccatgaaaattttgaaaccatatatgaggaatacatccatctcgtgctacttgtgtttccttctaaacagtcactttttaactgaggctggcattcatgtcttcattttgggctgtgtcagtgtaggtctccctaaaacagaggccaactggatagatgtaagatatgacctggagaaaattgaaagccttattcaatctattcatattgacaccactttatacactgacagtgactttcatcccagttgcaaagttactgcaatgaactgctttctcctggaattgcaggttattttacatgagtacagtaacatgactcttaatgaaacagtaagaaacgtgctctaccttgcaaacagcactctgtcttctaacaagaatgtagcagaatctggctgcaaggaatgtgaggagctggaggagaaaaccttcacagagtttttgcaaagctttatacgcattgtccaaatgttcatcaacacgtcctaactcgagctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccaggttatccgtgtaaccgccagtccgtgcttgcctagcgaactcacccgtcccggctggcgtgcgcagcccgggccgtgttgcgggccctcttaaggggcggcggcaggacggggactcccgccccgcctcttttcccccggggagtcaacccccggggggggtgttttttgggggggggcgcgaaggcgggcggcggcggcgggcgggcggcagggcagccccgcgcgcccccttccccgtccctcccccggagccggccgctcccccgcgggcgccgcccctccccccgcgcgccgcggggctgccttcccgcgggcgcccccgcgcggcttttttcccgcgcccgcccccgcgcggcaagacggggactagcaggctgtgccgcagaccaccacacactcccaagctccccgcccccccgaagacgccagtcgcaccaccgctcgccctcgcagaccagacagttgcaccaagcacccgcccgcccgcacacggttccccgccaccccctccctcccctccatcccgccgagctcgcggcagcccctcccccccgcgcgccacggggctgcggtcccgcggccgcctcccccgcggccgcctcccccgcgccccgccccgggggcttcccccgcccctccccccgcgcccgcggccccgagctcgcagcagcccctccctcccgcgccccgtgccttccctcccgctcctgcgggggggctcgggccacctgaccttcgtaacctgcactcaggtcagagccccagaccccccgcgggcgcgggagacgtgccgcccacccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgaataaaccacacaaggcggtacgttttcgtctgtctcgttctttatttctcacacacgcgcgcggccatcgccgcgtctgtcttaaaggcgcacagacgcccgattccttccccctctccccatctcccccctcccccgctcccggaagtttcccccccgtcactccccaaacagtccgtcgtcgtcgtcctccagctccgcgtccatgtccacgggctcgcgcctcggcggcgtggccagccccgcggcggtccccaccacctccacgccgccgcccgccgcggccagcaccgtccccgcgcggcccgcggccgacgcccagcgtatctgcgggggcgggcccgcgtccgcgtcgtcgcgcagcaccagcgggggcgcgtcgccgtcgggctcgagcagcgcccgcgcgcagaactcccgccgcggcccgcgcagctccgccgggccgccgcgcacggcgtcgcgccccagcgccacgtagacgggccgcagcggcgcgcccaggccccagcgcgcgcaggcgcggtgcgagtgcgcctcgtcctcgcagaagtccggcgcgccgggcgccatggcgtcgcccgcgcccgaggcggcggcccggccgtccagcgccgggagcacggcgcggcggtactcgcgcggggacatgggcaccagcgtgtcggggccgaagcgcgtgcgcacgcggtaccgcacgttggccccgcggcagaggcgcagcggcggcgcgtcggggtacaggcgcgcgtgcgcggcctccacgcgcgcgaagacccccggcccgaacacgcggccggaggccagcacggtgcggcgcaggtcccgcgccgccggccagcgcacggcgcactgcacggcgggcagcacctcgcaggccaggtaggcgtgctgccgcgagaccacgggcccgtcggcgggccagtccgcggcgcgcacggcgttgacgacgatgaggcggcggtcgcaggcgccggccagcagccccaggaactccacggcgccggcgaaggccaggtcccgcgtggacagcagcagcacgccctgcgcgcccagcgccgagacgtcgggggcgccggtccagttgcccgcccaggcggccgtggcgggcccgcagagccggttgcccagggccgccagcaggcaggacagcccgccgcgctcggcggaccactccggggggggcccgcccccggcgcggcccgcggccaggtcctcgcccggcagcggcgagtagaggatcaccacgcgcacgtcctccgggtcgggcacctggcgcatccaggccgccgcgcggcgcagcgggcccgaggcgcgcagcgggccgaaggcggcgggcgcgccgccggggggcggggcggcgcagcgcgcggccagcgaggccagcgcgcgcgggtcgaacatgagggccgggcgccacggcgcggggaagagcgggtggtccgtgagctcggccacggcccgcggggcgcagtaggcctccagggcggcggccgagggcgccggcgtgtggctgggccccggcggctggcggcgccagccgccctgcgggtcggggccctcggcgggccggcgggtcagcgccgcggggcgcggcggccgcggcggcggcgtcggcggggcggggggcgcggcccccgcgggaggggcggccgcggggcggggggcgtccgcgcggctcttcttcggggggcgcggggcgccgcccggcggcgccctggccggggcggggctcttgcgcttgcgcgcctcccgcggcgcggaggcgggcgcggcgagcgagtcggccgcggcgacggtgtcggccagcagggggcgcaggctctggttctggaagagcaggtccgcggcggcggcggcggcggagctcagcaggcgcgggctccgcggcagcgccgggcccagggccccggcgaccaggctcacggcgcgcacggcggccacggcggcctcgctgccgccggccacgcgcaggtccccgcgcaggcgcatcagcaccagcgcgtcgcgcacgaaccgcagctcgcgcagccaggcgcgcaggcggggcgcgtcggcgtgcggcggggcggccgcgcccgcgggccccgggcgcgggggcgcggcgggccgggctccggccagccccggcacggccgccaggtcgccgtcgaagccctccgccagcgcctccaggatcccgcggcaggcggccaggcactccacggccacgcggcccgcctccgcgcgccggccgccgccaccaccgccggcgccgtcgtcgtcgtcgtcgtcgtcggccccggccggcgcggaggcgggcgcggcgctcaggcgccccagggcggcgagcacccccgcggcgccgtagccggcgggcaccgcgcgctcgtcggccggcgacgccgccgccgacggcaacggggcggcggcggcggcgggcttcccgcgggcgtcgtcgccgtcgtggcggttggcgtcgccgccgtcgtcgggggttcgcgccccggtcagcgccgcgttctcgcgcgccagcaggggcgcgtaggcgcggcgcaggctggtcagcaggaagcccttctgcgcgcggtcgtagcggcggctcatggccacggcggccgccacgtgcgccaggccccagccgaagcggcccgccgccatggcgtaccccaggtggggcacggcccgcgccacgctgccggagatgaaggagctgctgttgcgcgccgcgcccgagatccggaagcaggcctggtccagcgccacgtccccgggcgccacgcgcgggttctggagccaccccatcgcctccgcgtccggcgtgtacagcagccgcgtgatcagggcgtactgctgcgccgcgtcgcccagctcgggcgcccacacgggcgccggggcgcccgaggcctcgaaccgggcccgcgcctcctccgcctcgggcgccccccagaggccggggcggctgtcgcccagcccgccgtacagcacgcgccccgggggcggggggccggccccgggccacggctccccgctgacgtacccgtcgcggtagcgcgcgtagaaggcgccggaggccgcgtcggcgtccagctcgacccgccggggccgcccggccgtgaagcggcccgtggcgtcgcggccggccaccgccgcgcgggcccggcggcgctccaggcggcccgcggtcgccgcgggggtccgggccggggcgggctcggccctgggcgggctcggccggggcgccgcccccggggccctcgcgggcacccccgcctcctcgtcgtccgcgccgagggtcccgcccgcggcgtggtctgcggcgctggcgggggcgcgggcggcgtcgtcgtcgtcgtcgtcgtcagacgaggaggcggatgcagacgaggaggaggaggcggaggaggaggcggaggacgccgacgacgaggatccggattttgatgagtcagaggcggccgagcgccggcggggggcgcgccggcggcggtggtggtggtggtggtggtgtcggcggggcgccgggggtcgcggcgacaggctggccatggggtccgggtacgccccgcggaccgcggacgtcgtctccggtccgcggacccagcggcccgcgtcgcggtcgtcgtcatcgtcgtcgtcgtcgtcgtcgtcgttctcctcgccataatcggcgcgcatggagggggtccgcggcggagaaggcgagcgggccgcttcttcttccgcgccgtcgcgctccggggggggcgacgggatcgtgcgaacggcctcgtccaccatcgaggccagcagggccagctgccgcggcgagacgacgccgtccgcggcaggctcgtcgacggcctccccggacgccggggccgcctcgtcggcatcggcatcggcggcggcgtcgtcggcctcgtcttcgttctcctccggcccaccgtgccacccgaacccgggccgcgcggcggggcgacggtccgggttcggggtgggcggcggtccgtcggctggatccggagatccggggccgccggtcgtctccgccgcggcccggagacgtcccccgtcctcgtccgccatcgcgacctcggccccgcggccctgcgtcgtcgtcgtcgtcttcttcttcttccgctgctccgccgacatcgcctccgaccggggtgtgcgggggggggtcttcttcttcttcttcaggggcggcagtgggggggggtggttggcagtctctctcccccccgtgcggtgcgtgcgtgtgcctgtgtcttttcgcctctccgcgccgatcgggtagatcctggcggccgcgtcggtagccgcgctccgtgtggacgatcgccccgtcgcctggctgatatagtcctcggggcgcgcggggcggggggaaaggaggaggacgcggaggaggagcgatcgacgccgccgcgccccggctcgccggggttccgcccccaggtggaaccgcattatgcgcggccccgccccgacgcccgcgcgtccgcgtccgtggcggcggcccgttggtcgcgccgccgccggctccgcccgcgcggcatctcattagcgcccggcgcgggcggcttccgcttccgcccgcgatgctaatgagaccctcgtcgcgggcgggctcgctcccctgcccttccgggttcgtggtaatgagatgccggccccgcgctcccgttggcccccgccggccccaaaggggccggcgaggtcgccccgttggtccgcgggcggctccgccccaaagggggcggggccgcagggtaaaagaagtgagaacgcgaagcgttcgcacttcgtcctaatagtatatatattattagggcaaagtgcgagcgctggcgccctgcccggggcccgcgtcatcccgcgggctccgccccaaagggggcggggccgcagggtaaaagaagtgagaacgcgaagcgttcgcacttcgtcctaatagtatatatattattagggcaaagtgcgagcactggcgccctgcccggggcccgcgtcatcccgcgggctccgccccgaggcgggcccggacggggggcgggccgttcctcgcgcacataaagggccggcgtcccggtcgccgccgcaccaggggcacaccggctgcgcggcggagaccgggacggcagcggcggcatcgcgaagggggccacagcgagacagagacgccggcggcgagcggggcaccgacgcacccggatcggatcggatacagagacgcgggcgcatcggttccttttcgttctgcctttccctcccccccccccccccaccctgtacgtaccgcgaggacccatccacccactgcagccttatcgcaggtacggtgacccggggggccgggccggggggacgggccggggggacgggccggggggacgggccggggggacgggccggggggacgggccggggggacgggccggggggacgggccggggggacgggccggggggccggggggccggggggccggggggacggggggacgggccggggggacgggccggggggccggggggacggggggacggggggacggggggacggggggacggggggacggggggacggggggacggggggacggggggacggggggacggggggacggggggacggggggacggggggacgggccggggggacggggggacgggccggggggacggggggacggggccccgatcccaacatccgcgctttctcgcaggccgggcgccgccttcgtggacgggacaccggtgtggtaactggcgacaaggcgttgccactatggcagacatccccccggacccgcccgcgctcaacacgacgcctgcgaatcatgctcccccatccccacccccgggttcacggaagcgcagacgccccgtcctccccagctcgtcggaatctgagggtaagcccgacacagaatcggaatcctcctcgaccgagtcgtccgaggatgaggcgggagacctacgcggcgggcgccgtcgctccccgcgggagctcggggggaggtattttttggatctgtcggcagaatcgaccacggggacggaatcggagggaacggggccgtcggacgacgatgatgatgatgcgtcagacggctggttggttgacacacccccccgcaaatccaagcgaccccgaatcaacctgcgattaacgagctcccccgaccggcgtgcgggtgtggttttccccgaggtgtggagaagcgacagacctatccgcgcggcgcaaccccaggccccggcccagtcttccggggatcgcgcagccgcaccgcggcgctctgctcgccaggcccagatgcggagcggagccgcctggacgcttgatctgcattacatacgccagtgcgtcaaccagctctttcggatcctgcgtgccgccccgaacccgcccggcagcgccaaccgcctgcgccacctggtgcgagactgctacctcatgggctactgccggacccgcctggggccgcgcacgtggggccgcctgctgcagatctcgggcggaacctgggacgtgcgcctgcgaaacgcaatccgggaggtcgaggcgcattttgaacccgccgccgagcccgtgtgcgagctgccctgtctgaacgccaggcgttacggccccgagtgtgatgttggcaatctcgagaccaacggcggctcgacgagcgatgatgagatatcggatgcgacggactcggacgataccctcgcgtcccattccgacacggagggggggccctccccggccggccgggagaacccggaatccgcgtccggcggggctatcgcggctcggctggagtgtgagtttgggacgtttgactggacgtccgaggagggctcccagccctggctgtccgcggtggtcgccgataccagctccgccgaacgctctggcctacccgccccgggcgcgtgtcgcgcaacggaagccccagaacgcgaggacgggtgccgaaaaatgcgcttccccgccgcctgcccctatccctgcggccacacatttctccggccatgagcgcgggacccccagcccggtgtgtttgccaaacgaaaaataaacgccctacaagaaagcttttgtgtctgagtgtctggtttttctgggggtggaggaaggaacgacaaaaaaaagaaacaaacgcgacaccgctcgtacgtgtaatggggcgcagtgttttttattagcatcggggggggttagaggttggtgattggatagcaaacgtgggatgacggaggccactcgtcgccaacggccagcgggggcccggggttctgggggtcatcgtcccccgtctgccaggagggctcatcgggaatctcgggtcgccccatgcacgtaaaacacgggcgctgcgtggggtgggtcgccggatgcgggcgggatgatgcggggcggggtttgttgtgaggagccacgagggaccgtagccagcgaagacagctgcgttcccggtcgccgggcaccaccacgccgtattggtattcgtatcggctaaggagattttccagggggtgattaggcgctgcggggaacggggtccacgacacggtccgctcgggcaaaaaccgatcgggcaggggccacggttcccccacccacgcgtcgttggtcttcgtggcgatgaagcgaaaccccagccgggttttttgtgcgtactcgaaaaacggcacacacaggtccgccgccccgaccacccacaggtggtatagccggtgggggccggggcgctcttgatgcaggagccgaaaacacgcaggggcatccagaatctcgatgctttccagggggtcgtcctccgcaaacaggcccgtcgtggtgtttgggggacagcgacaggagcgggttcgcacgatcggtcgggtgaatttgggcaagtccatcagaggctcggccagcctgcgaaggttcgccgggcgaaccaccaccggggttcccagaggctcggaggccaggatccggcattgccgaagcagaaaactccacagagccgggcttgcgtcagcggaagtccgcggcagggcgtttcgttggtctaggagggtaaccacacttacaacaacaacgcccatgtcggtatattaggcccgtggtccgatcttcactcactcgcctgtctgcggacctatgcacggcgggacggcgcgcggacccgggggggctgcttgctatcacacggcccgttcgcacgttcgattttttcagccttgtttggttggctaggtatcccggataatctgacgttccggatatagggggcggggggtagtggggggtgtgtcgacaaactgccgcttcttaaaacaccggggcccgtcgctcggggtgctcgttggttggcacgcgcgacgcggcaaatggcctgtcgtaagttctgtggggtctaccgtagacccgacaagagacaggaggcgtccgtcccgccggagacaaacacggccccggccttcccggcgagcaccttttatacccccgcggaggatgcgtacctggcccccgggcccccggaaaccatccacccttcccgcccaccgtcccccggcgaggctgcgcgcctgtgtcagctgcaggagatcttggcccagatgcacagcgacgaggactaccccatcgtggacgccgcgggtgcggaggaggaagacgaggccgacgatgacgccccggatgacgtggcctacccggaggactacgcggaggggcgttttctgtccatggtttcggccgcccccctgcccggagccagcggccatcctcctgttccgggccgcgcagccccccccgacgtccggacctgcgacagcggtaaggtgggggccacggggttcaccccggaagagctcgacaccatggaccgggaggcacttcgggccatcagccgcgggtgcaagcccccttcgaccctggcaaaactggtgaccgggctgggattcgcgatccacggagcgctcatcccggggtcggaggggtgtgtctttgatagcagccacccgaactaccctcatcgggtaatcgtcaaggcggggtggtacgccagcacgagccacgaggcgcggctgctgagacgcctgaaccaccccgcgatcctacccctcctggacctgcacgtcgtttctggggtcacgtgtctggtcctccccaagtatcactgcgacctgtatacctatctgagcaagcgcccgtctccgttgggccacctacagataaccgcggtctcccggcagctcttgagcgccatcgactacgtccactgcgaaggcatcatccaccgcgatattaagaccgagaacatcttcatcaacacccccgagaacatctgtctgggggactttggggcggcgtgctttgtgcgcgggtgtcgatcgagccccttccattacgggatcgcaggcaccatcgatacaaacgcccccgaggtcctggccggggatccgtacacccaggtaatcgacatctggagcgccggcctggtgatctttgagaccgccgtccacaccgcgtccttgttctcggccccgcgcgaccccgaaaggcggccgtgcgacaaccagatcgcgcgcatcatccgacaggcccaggtacacgtcgacgagtttccgacgcacgcggaatcgcgcctcaccgcgcactaccgctcgcgggcggccgggaacaatcgtccggcgtggacccgaccggcgtggacccgctactacaagatccacacagacgtcgaatatctcatatgcaaagcccttacctttgacgcggcgctccgcccaagcgccgcggagttgctgcgcctgccgctatttcaccctaagtgaccccgctccccccggggggcgtggaggggggggctggttggatgtttttgcacaaaaagacgcggccctcgggctttggtgtttttggcaccttgccgcccggcgtcatgcacgccatcgctcccaggttgcttcttctttttgttctttctggtcttccggggacacgcggcgggtcgggtgtccccggaccaattaatccccccaacagcgatgttgttttcccgggaggttcccccgtggctcaatattgttatgcctatccccggttggacgatcccgggcccttgggttccgcggacgccgggcggcaagacctgccccggcgcgtcgtccgtcacgagcccctgggccgctcgttcctcacgggggggctggttttgctggcgccgccggtacgcggatttggcgcacccaacgcaacgtatgcggcccgtgtgacgtactaccggctcacccgcgcctgccgtcagcccatcctccttcggcagtatggagggtgtcgcggcggcgagccgccgtccccaaagacgtgcgggtcgtacacgtacacgtaccagggcggcgggcctccgacccggtacgctctcgtaaatgcttccctgctggtgccgatctgggaccgcgccgcggagacattcgagtaccagatcgaactcggcggcgagctgcacgtgggtctgttgtgggtagaggtgggcggggagggccccggccccaccgcccccccacaggcggcgcgtgcggagggcggcccgtgcgtccccccggtccccgcgggccgcccgtggcgctcggtgcccccggtatggtattccgcccccaaccccgggtttcgtggcctgcgtttccgggagcgctgtctgcccccacagacgcccgccgcccccagcgacctaccacgcgtcgcttttgctccccagagcctgctggtggggattacgggccgcacgtttattcggatggcacgacccacggaagacgtcggggtcctgccgccccattgggcccccggggccctagatgacggtccgtacgcccccttcccaccccgcccgcggtttcgacgcgccctgcggacagaccccgagggggtcgaccccgacgttcgggccccccgaaccgggcggcgcctcatggccttgaccgaggacacgtcctccgattcgcctacgtccgctccggagaagacgcccctccctgtgtcggccaccgccatggcaccctcagtcgacccaagcgcggaaccgaccgcccccgcaaccactactccccccgacgagatggccacacaagccgcaacggtcgccgttacgccggaggaaacggcagtcgcctccccgcccgcgactgcatccgtggagtcgtcgccactccccgccgcggcggcggcaacgcccggggccgggcacacgaacaccagcagcgcctccgcagcgaaaacgccccccaccacaccagcccccacgacccccccgcccacgtctacccacgcgaccccccgccccacgactccggggccccaaacaacccctcccggacccgcaaccccgggtccggtgggcgcctccgccgcgcccacggccgattcccccctcaccgcctcgccccccgctaccgcgccggggccctcggccgccaacgtttcggtcgccgcgaccaccgccacgcccggaacccggggcaccgcccgtacccccccaacggacccaaagacgcacccacacggacccgcggacgctccccccggctcgccagcccccccaccccccgaacatcgcggcggacccgaggagtttgagggcgccggggacggcgaaccccccgaggacgacgacagcgccaccggcctcgccttccgaactccgaaccccaacaaaccaccccccgcgcgccccgggcccatccgccccacgctcccgccaggaattcttgggccgctcgcccccaacacgcctcgcccccccgcccaagctcccgctaaggacatgccctcgggccccacaccccaacacatccccctgttctggttcctaacggcctcccctgctctagatatcctctttatcatcagcaccaccatccacacggcggcgttcgtttgtctggtcgccttggcagcacaactttggcgcggccgggcggggcgcaggcgatacgcgcacccgagcgtgcgttacgtatgtctgccacccgagcgggattagggggtgggggtggggggcgagaaacgatgaaggacgggaaagggaacagcgaccaaatgtcacgataagaacaataaacctgtgacgtcaatcagatatgtgagtttggttgtgttttgtgggactgggggcggggggtgggaggtatcagtgggtgacagagtcttttaaaagacgtgtcccggggccctcgagacgcgcaacttttggccacacagagaaaggcccccagacgaagtcacccgggtccccgaacaaaaacaaaaaccttgaccgccgccggggggcgtgcctgttgttttggtctcaatggatcggtatgccgttcggacctgggggattgtgggaatcctcgggtgtgctgctgttggggccgcacccaccggccccgcgtccgatacaacaaacgcgaccgcacgcctccccacgcaccccccactcatccgttccgggggctttgccgtccccctcatcgtgggggggctgtgtctcatgattctggggatggcgtgtctactcgaggtcctgcgtcgcctgggtcgcgagttggcgaggtgctgcccccacgcgggccaatttgccccatgatttttcgcctttctggccttgcccccaccccatcgccccgattgtgtgtcgggtgcccggggtacagcagctatggagcggtcggtaatataactttggttgtcgccacacgccccgtgccgggcatgggttgtgcgggaaggacgaaataatccggcgatccccaagcgtaccaactgggggggggggggggaaaagaaactaaaaacacatcaagcccacaacccatcccacaatgggggttatggcggacccaccgcaccaccatactccgattcgaccacatatgcaaccaaatcacccccagaggggaggttccatttttacgaggaggaggagtataatagagtctttgtgtttaaaacccggggtcggtgtggtgttcggtcataagctgcattgcgaacgactagtcgccgtttttcgtgtgcatcgcgtatcacggcatggggcgtttgacctccggcgtcgggacggcggccctgctagttgtcgcggtgggactccgcgtcgtctgcgccaaatacgccttagcagacccctcgcttaagatggccgatcccaatcgatttcgcgggaagaaccttccggttttggaccagctgaccgacccccccggggtgaagcgtgtttaccacattcagccgagcctggaggacccgttccagccccccagcatcccgatcactgtgtactacgcagtgctggaacgtgcctgccgcagcgtgctcctacatgccccatcggaggccccccagatcgtgcgcggggcttcggacgaggcccgaaagcacacgtacaacctgaccatcgcctggtatcgcatgggagacaattgcgctatccccatcacggttatggaatacaccgagtgcccctacaacaagtcgttgggggtctgccccatccgaacgcagccccgctggagctactatgacagctttagcgccgtcagcgaggataacctgggattcctgatgcacgcccccgccttcgagaccgcgggtacgtacctgcggctagtgaagataaacgactggacggagatcacacaatttatcctggagcaccgggcccgcgcctcctgcaagtacgctctccccctgcgcatccccccggcagcgtgcctcacctcgaaggcctaccaacagggcgtgacggtcgacagcatcgggatgctaccccgctttatccccgaaaaccagcgcaccgtcgccctatacagcttaaaaatcgccgggtggcacggccccaagcccccgtacaccagcaccctgctgccgccggagctgtccgacaccaccaacgccacgcaacccgaactcgttccggaagaccccgaggactcggccctcttagaggatcccgccgggacggtgtcttcgcagatccccccaaactggcacatcccgtcgatccaggacgtcgcgccgcaccacgcccccgccgcccccagcaacccgggcctgatcatcggcgcgctggccggcagtaccctggcggtgctggtcatcggcggtattgcgttttgggtacgccgccgcgctcagatggcccccaagcgcctacgtctcccccacatccgggatgacgacgcgcccccctcgcaccagccattgttttactagaggagtttccccgctcccgtgtacctctgggcccgtgtgggagggtggctggggtatttgggtgggacttggactccgcataaagggagtctcgaaggagggaaactaggacagttcataggccgggagcgtggggcgcgcaccgctgtcccgacgattagccaccgcgcccacagccacctcgacccgtccgatcccggtatgcccggccgctcgctgcagggcctggcgatcctgggcctgtgggtctgcgccaccggcctggtcgtccgcggccccacggtcagtctggtctcagactcactcgtggatgccggggccgtggggccccagggcttcgtggaagaggacctgcgtgttttcggggagcttcattttgtgggggcccaggtcccccacacaaactactacgacggcatcatcgagctgtttcactaccccctggggaaccactgcccccgcgttgtacacgtggtcacactgaccgcatgcccccgccgccccgccgtggcgttcaccttgtgtcgctcgacgcaccacgcccacagccccgcctatccgaccctggagctgggtctggcgcggcagccgcttctgcgggttcgaacggcaacgcgcgactatgccggtctgtatgtcctgcgcgtatgggtcggcagcgcgacgaacgccagccggtttgttttgggggtggcgctctctgccaacgggacgtttgtgtataacggctcggactacggctcctgcgatccggcgcagcttcccttttcggccccgcgcctgggaccctcgagcgtatacacccccggagcctcccgacccacccctccacggacaacgacacccccgtcctccccccgagacccgacccccgcccccggggacacagggacgcccgcgcccgcgagcggcgagatagccccgcccaattccacgcgatcggccagcgaatcgagacacaggctaaccgtagcccaggtaatccagatcgccataccggcgtccatcatcgcctttgtgtttctgggcagctgtatctgcttcatccatagatgccagcgccgatacaggcgcccccgcggccagatttacaaccccgggggcgtttcctgcgcggtcaacgaggcggccatggcccgcctcggagccgagctgcgatcccacccaaacaccccccccaaaccccgacgccgttcgtcgtcgtccacgaccatgccttccctaacgtcgatagctgaggaatcggagccaggtccagtcgtgctgctgtccgtcagtcctcggccccgcagtggcccgacggccccccaagaggtctaggtccaagcgggccgttcggcaggcccgccccaccgcccccatcgtggttatttccccccccccccaataaaccgatgttatttgcctatatgcgtgtgttggatccctttgtgatcgttcgtcattccccggatggcatgggaggcgggtaatggatgggcggggcccgggggggaggaaaaagaataaagggggtagtgtcggagaggcccgccgcgcatttaaggagtcgccgccccgactctgtgtcttcgggtgacttggtgcgccgccgtcagctagtctccgatctgccccgaccgacggctcctgccacccgaacatggctcgcggggccgggttggtgttttttgttggagtttgggtcgtatcgtgcctggcggcagcacccagaacgtcctggaaacgggtaacctcgggcgaggacgtggtgttgcttccggcgcccgcggaacgcacccgggcccacaaactactgtgggccgcggaacccctggatgcctgcggtcccctgcgcccgtcgtgggtggcgctgtggcccccccgacgggtgctcgagacggtcgtggatgcggcgtgcatgcgcgccccggaaccgctcgccatagcatacagtcccccgttccccgcgggcgacgagggactgtattcggagttggcgtggcgcgatcgcgtagccgtggtcaacgagagtctggtcatctacggggccctggagacggacagcggtctgtacaccctgtccgtggtcggcctaagcgacgaggcgcgccaagtggcgtcggtggttctggtcgtggagcccgcccctgtgccgaccccgacccccgacgactacgacgaagaagacgacgcgggcgtgagcgaacgcacgccggtcagcgttccccccccaacccccccccgtcgtccccccgtcgcccccccgacgcaccctcgtgttatccccgaggtgtcccacgtgcgcggggtaacggtccatatggagaccccggaggccattctgtttgcccccggggagacgtttgggacgaacgtctccatccacgccattgcccacgacgacggtccgtacgccatggacgtcgtctggatgcggtttgacgtgccgtcctcgtgcgccgagatgcggatctacgaagcttgtctgtatcacccgcagcttccagagtgtctatctccggccgacgcgccgtgcgccgtaagttcctgggcgtaccgcctggcggtccgcagctacgccggctgttccaggactacgcccccgccgcgatgttttgccgaggctcgcatggaaccggtcccggggttggcgtggctggcctccaccgtcaatctggaattccagcacgcctccccccagcacgccggcctctacctgtgcgtggtgtacgtggacgatcatatccacgcctggggccacatgaccatcagcaccgcggcgcagtaccggaacgcggtggtggaacagcacctcccccagcgccagcccgagcccgtcgagcccacccgcccgcacgtgagagccccccatcccgcgccctccgcgcgcggcccgctgcgcctcggggcggtgctgggggcggccctgttgctggccgccctcgggctgtccgcgtgggcgtgcatgacctgctggcgcaggcgctcctggcgggcggttaaaagccgggcctcggcgacgggccccacttacattcgcgtggcggacagcgagctgtacgcggactggagttcggacagcgagggggagcgcgacgggtccctgtggcaggaccctccggagagacccgactctccctccacaaatggatccggctttgagatcttatcaccaacggctccgtctgtatacccccatagcgaggggcgtaaatctcgccgcccgctcaccacctttggttcgggaagcccgggccgtcgtcactcccaggcctcctatccgtccgtcctctggtaaggcgtcttccgacgacgcggacgtcggcgatgaactgattgccatcgcggacgcacgcggggacccgccagagaccctgccccccggcgcgggcggcgccgcgcccgcgtgccgcagaccacctcgcggcggctcccccgcggcctttcccgtggccctccacgccgtggacgccccctcccaattcgtcacctggctcgccgtgcgctggctgcggggggcggtgggtctcggggccgtcctgtgcgggattgcgttttacgtgacgtcaatcgcccgaggcgcataaaggtccggcggccagccccgccgcagctcataaaaatcgtgagtcacggcaaccgcaccttcgcctccggccctccgccagcgcccttccgcgtccgcgatgacctcccggcccgccgaccaagactcggtgcgttccagcgcgtcggtgccgctttaccccgcggcctcgcccgtcccggcagaagcctactactcggaaagcgaagacgaggccgccaacgacttcctcgtgcgcatgggccgccagcagtcggtcctaaggcgccgacggcggcgcacgcggtgcgtcgggctggttatcgcctgtctcgtcgtggccctcctatctggagggttcggggcacttttggtgtggctgctccgctaaatgacgcctcgatgtatggcgccttcttcgcccccacccctcgccgcgacccacgtccgtatgttaattgcaataaagtggttgattgtcattacggtctactaggttgtcttttttttttgggggggggggaggaaatgcagaaaagggtaagaaattctcggaatttcacccccgggggggggcaagtgcagtaacccagttcctcagtgtttgggaaatctattgaactctcccggctcctccgtgttagggaagtctcttggggaaatctattgacctctcgccccccccccccaggaggggggcagtgcagtaccccagttcctccgtgctggggaaatctctctgccgggtacgggctccagacgaaggacccatacatttccccatccgcaccccacatctggcgttctagagtcacgacgcatttgcccccgtccccgcagcaacacacaaagcgatttcaattttcacgattttattattaattacaccaaccaccctgtccccgggacgtggtcaggaccgggggtccgcacccaaacgcacgaaacaaatgctggcagtgtgccgaatataaccccgcgtaggaacacgtcgacgcgtgcgccaaacagcaccagaaggcgcatgccatcagcaggtcgtgcatatggcgatgtgtttggacgcagggcgcagccgcggcgataaaattcatggcggccgtccgccagggccacagcggcgaggactccctgttggcccgaagccattgggtatgaaccagctgcgcctcctgtccgaccctggctcccgccagcgggggcggtgggtcgtgggtgttgagagcacacaggcgggacacctcgatcaccgtccgaaaaaaggcccggtggtccgcgggcagcatctgcaggtgcgccagggcctgggcgttgagagggtacaactcggagccgggggactccgggggccggtccgcgcggtgccgcgagttggcacgctttggggcccgggtgtcggacgcgggcgcgttatggatcccgacgcggggcagaacgtacgtgcgttggcgcggcgatgaggggtccgggctgccgaggggggcgtaggggaccgggctaggcaagcccgcgggttgcgcggggttcccgtgggggtctaggctccctgggcacccgtgggggtcgtgggggtcgcgggtccctgggtatgcgcgggaccctgggttctctgggagatcgtggaactcgcggttccctgggctctcggggaacccggggctccctggggacacgtggtgccctgggaattcttgatggtcggacggcttcagatggcttcgggatcgagagggccgcacagactcgtagtagacccgaatctccacgtttccccgccgccggatcatggtcgccgccccggtgcgggggcccgtcggtcggaagcgagtgcccttcaagcgtgtccgctcctctgggctgcatgccgtcggatggggtgccttttaaggaaaggtctcggctgcccgccccaaccggggtttgggggtgggccggggaaaccccggatgccatgggggggtcacaccctaagcgccggcgcgctggttgggtgggggtagaggggagtccccggtcgacgagatcgtataagctgggtaccgagctcgaattcatcgatgatatcagatcgatccccatggtgtcccgtccacgaaggcggcgcccggcctgcgagaaagcgcggatgttgggatcggggccccgtccccccgttccccggcccgtccccccgtccccccggcccgtccccccggcccgtccccccggcccggccccccgggtcaccgtacctgcgataaggctgcagtgggtggatgggtcctcgcggtacgtacagggtgggggggggggggggagggaaaggcagaacgaaaaggaaccgatgcgcccgcgtctctgtatccgatccgatccgggtgcgtcggtgccccgctcgccgccggcgtctctgtctcgctgtggcccccttcgcgatgccgccgctgccgtcccggtctccgccgcgcagccggtgtgcccctggtgcggcggcgaccgggacgccggccctttatgtgcgcgaggaacggcccgccccccgtccgggcccgcctcggggcggagcccgcgggatgacgcgggccccgggcagggcgccagtgctcgcactttgccctaataatatatatactattaggacgaagtgcgaacgcttcgcgttctcacttcttttaccctgcggccccgccccctttggggcggagcccgcgggatgacgcgggccccgggcagggcgccagcgctcgcactttgccctaataatatatatactattaggacgaagtgcgaacgcttcgcgttctcacttcttttaccctgcggccccgccccctttggggcggagccgcccgcggaccaacggggcgacctcgccggcccctttggggccggcgggggccaacgggagcgcggggccggcatctcattaccacgaacccggaagggcaggggagcgagcccgcccgcgacgagggtctcattagcatcgcgggcggaagcggaagccgcccgcgccgggcgctaatgagatgccgcgcgggcggagccggcggcggcgcgaccaacgggccgccgccacggacgcggacgcgcgggcgtcggggcggggccgcgcataatgcggttccacctgggggcggaaccccggcgagccggggcgcggcggcgtcgatcgctcctcctccgcgtcctcctcctttccccccgccccgcgcgccccgaggactatatcagccaggcgacggggcgatcgtccacacggagcgcggctaccgacgcggccgccaggatctacccgatcggcgcggagaggcgaaaagacacaggcacacgcacgcaccgcacgggggggagagagactgccaaccacccccccccactgccgcccctgaagaagaagaagaagacccccccccgcacaccccggtcggaggcgatgtcggcggagcagcggaagaagaagaagacgacgacgacgacgcagggccgcggggccgaggtcgcgatggcggacgaggacgggggacgtctccgggccgcggcggagacgaccggcggccccggatctccggatccagccgacggaccgccgcccaccccgaacccggaccgtcgccccgccgcgcggcccgggttcgggtggcacggtgggccggaggagaacgaagacgaggccgacgacgccgccgccgatgccgatgccgacgaggcggccccggcgtccggggaggccgtcgacgagcctgccgcggacggcgtcgtctcgccgcggcagctggccctgctggcctcgatggtggacgaggccgttcgcacgatcccgtcgccccccccggagcgcgacggcgcggaagaagaagcggcccgctcgccttctccgccgcggaccccctccatgcgcgccgattatggcgaggagaacgacgacgacgacgacgacgacgatgacgacgaccgcgacgcgggccgctgggtccgcggaccggagacgacgtccgcggtccgcggggcgtacccggaccccatggccagcctgtcgccgcgacccccggcgccccgccgacaccaccaccaccaccaccaccgccgccggcgcgccccccgccggcgctcggccgcctctgactcatcaaaatccggatcctcgtcgtcggcgtcctccgcctcctcctccgcctcctcctcctcgtctgcatccgcctcctcgtctgacgacgacgacgacgacgacgccgcccgcgcccccgccagcgccgcagaccacgccgcgggcgggaccctcggcgcggacgacgaggaggcgggggtgcccgcgagggccccgggggcggcgccccggccgagcccgcccagggccgagcccgccccggcccggacccccgcggcgaccgcgggccgcctggagcgccgccgggcccgcgcggcggtggccggccgcgacgccacgggccgcttcacggccgggcggccccggcgggtcgagctggacgccgacgcggcctccggcgccttctacgcgcgctaccgcgacgggtacgtcagcggggagccgtggcccggggccggccccccgcccccggggcgcgtgctgtacggcgggctgggcgacagccgccccggcctctggggggcgcccgaggcggaggaggcgcgggcccggttcgaggcctcgggcgccccggcgcccgtgtgggcgcccgagctgggcgacgcggcgcagcagtacgccctgatcacgcggctgctgtacacgccggacgcggaggcgatggggtggctccagaacccgcgcgtggcgcccggggacgtggcgctggaccaggcctgcttccggatctcgggcgcggcgcgcaacagcagctccttcatctccggcagcgtggcgcgggccgtgccccacctggggtacgccatggcggcgggccgcttcggctggggcctggcgcacgtggcggccgccgtggccatgagccgccgctacgaccgcgcgcagaagggcttcctgctgaccagcctgcgccgcgcctacgcgcccctgctggcgcgcgagaacgcggcgctgaccggggcgcgaacccccgacgacggcggcgacgccaaccgccacgacggcgacgacgcccgcgggaagcccgccgccgccgccgccccgttgccgtcggcggcggcgtcgccggccgacgagcgcgcggtgcccgccggctacggcgccgcgggggtgctcgccgccctggggcgcctgagcgccgcgcccgcctccgcgccggccggggccgacgacgacgacgacgacgacggcgccggcggtggtggcggcggccggcgcgcggaggcgggccgcgtggccgtggagtgcctggccgcctgccgcgggatcctggaggcgctggcggagggcttcgacggcgacctggcggccgtgccggggctggccggagcccggcccgccgcgcccccgcgcccggggcccgcgggcgcggccgccccgccgcacgccgacgcgccccgcctgcgcgcctggctgcgcgagctgcggttcgtgcgcgacgcgctggtgctgatgcgcctgcgcggggacctgcgcgtggccggcggcagcgaggccgccgtggccgccgtgcgcgccgtgagcctggtcgccggggccctgggcccggcgctgccgcggagcccgcgcctgctgagctccgccgccgccgccgccgcggacctgctcttccagaaccagagcctgcgccccctgctggccgacaccgtcgccgcggccgactcgctcgccgcgcccgcctccgcgccgcgggaggcgcgcaagcgcaagagccccgccccggccagggcgccgccgggcggcgccccgcgccccccgaagaagagccgcgcggacgccccccgccccgcggccgcccctcccgcgggggccgcgccccccgccccgccgacgccgccgccgcggccgccgcgccccgcggcgctgacccgccggcccgccgagggccccgacccgcagggcggctggcgccgccagccgccggggcccagccacacgccggcgccctcggccgccgccctggaggcctactgcgccccgcgggccgtggccgagctcacggaccacccgctcttccccgcgccgtggcgcccggccctcatgttcgacccgcgcgcgctggcctcgctggccgcgcgctgcgccgccccgccccccggcggcgcgcccgccgccttcggcccgctgcgcgcctcgggcccgctgcgccgcgcggcggcctggatgcgccaggtgcccgacccggaggacgtgcgcgtggtgatcctctactcgccgctgccgggcgaggacctggccgcgggccgcgccgggggcgggccccccccggagtggtccgccgagcgcggcgggctgtcctgcctgctggcggccctgggcaaccggctctgcgggcccgccacggccgcctgggcgggcaactggaccggcgcccccgacgtctcggcgctgggcgcgcagggcgtgctgctgctgtccacgcgggacctggccttcgccggcgccgtggagttcctggggctgctggccggcgcctgcgaccgccgcctcatcgtcgtcaacgccgtgcgcgccgcggactggcccgccgacgggcccgtggtctcgcggcagcacgcctacctggcctgcgaggtgctgcccgccgtgcagtgcgccgtgcgctggccggcggcgcgggacctgcgccgcaccgtgctggcctccggccgcgtgttcgggccgggggtcttcgcgcgcgtggaggccgcgcacgcgcgcctgtaccccgacgcgccgccgctgcgcctctgccgcggggccaacgtgcggtaccgcgtgcgcacgcgcttcggccccgacacgctggtgcccatgtccccgcgcgagtaccgccgcgccgtgctcccggcgctggacggccgggccgccgcctcgggcgcgggcgacgccatggcgcccggcgcgccggacttctgcgaggacgaggcgcactcgcaccgcgcctgcgcgcgctggggcctgggcgcgccgctgcggcccgtctacgtggcgctggggcgcgacgccgtgcgcggcggcccggcggagctgcgcgggccgcggcgggagttctgcgcgcgggcgctgctcgagcccgacggcgacgcgcccccgctggtgctgcgcgacgacgcggacgcgggcccgcccccgcagatacgctgggcgtcggccgcgggccgcgcggggacggtgctggccgcggcgggcggcggcgtggaggtggtggggaccgccgcggggctggccacgccgccgaggcgcgagcccgtggacatggacgcggagctggaggacgacgacgacggactgtttggggagtgacgggggggaaacttccgggagcgggggaggggggagatggggagagggggaaggaatcgggcgtctgtgcgcctttaagacagacgcggcgatggccgcgcgcgtgtgtgagaaataaagaacgagacagacgaaaacgtaccgccttgtgtggtttattcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggtgggcggcacgtctcccgcgcccgcggggggtctggggctctgacctgagtgcaggttacgaaggtcaggtggcccgagcccccccgcaggagcgggagggaaggcacggggcgcgggagggaggggctgctgcgagctcggggccgcgggcgcggggggaggggcgggggaagcccccggggcggggcgcgggggaggcggccgcgggggaggcggccgcgggaccgcagccccgtggcgcgcgggggggaggggctgccgcgagctcggcgggatggaggggagggagggggtggcggggaaccgtgtgcgggcgggcgggtgcttggtgcaactgtctggtctgcgagggcgagcggtggtgcgactggcgtcttcgggggggcggggagcttgggagtgtgtggtggtctgcggcacagcctgctagtccccgtcttgccgcgcgggggcgggcgcgggaaaaaagccgcgcgggggcgcccgcgggaaggcagccccgcggcgcgcggggggaggggcggcgcccgcgggggagcggccggctccgggggagggacggggaagggggcgcgcggggctgccctgccgcccgcccgccgccgccgcccgccttcgcgcccccccccaaaaaacaccccccccgggggttgactccccgggggaaaagaggcggggcggg

SEQ ID NO: 21 - DNA, 155657 bp, synthetic construct
  source 1..155657: mol_type = other DNA
agtccccgtcttgccgcgcgggggcgggcgcgggaaaaaagccgcgcgggggcgcccgcgggaaggcagccccgcggcgcgcggggggaggggcggcgcccgcgggggagcggccggctccgggggagggacggggaagggggcgcgcggggctgccctgccgcccgcccgccgccgccgcccgccttcgcgcccccccccaaaaaacaccccccccgggggttgactccccgggggaaaagaggcggggcgggagtccccgtcctgccgccgccccttaagagggcccgcaacacggcccgggctgcgcacgccagccgggacgggtgagttcgctaggcaagcacggactggcggttacacggataacctggttctttccgcctcagaagccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagcatttaggtgacactatagaatagggccctctagctcgagttacttgccggggctcaggctcaggctcttctgggtgtagtggttgtgcagggcctcgtgcatcacgctgcagctgaacacgttgccctgctgccaccggctcttgtccacggtcagcttgctgtacaggaagaagctgccgtcgctgtccagcacggggggggtggtcttgtagttgttctcgggctggccgttgctctcccactccacggcgatgtcgctggggtagaagcccttcaccaggcaggtcaggctcacctggttcttggtcagctcgtcccggctggggggcagggtgtacacctggggctcccggggctggcccacgctggggccgcccagcagctcgggggcggggcagggggggcaggtgtgggtcttgtcgcagctcttgggctccagggtctggaactggccggcgggccgggggctggggctggggtgggcggtgggcacctcggcccgccgctcggtcacccgcagctcggcccgcaggctctccttgatctggatcttgggggccaggctgatcacgccgcacacgtaggtgccgctgtcgttccgccgggcccgcaccacgctcatgtggaagtcccggccgttgggcagctgggtcacccggaaccggcagtcctggccgggctggctccggtcctcggggaaggcggccagggtgtcggtctggccgctggggctctcccggtgccacaccacgtggaagctctcgctggtgttgctgaagctgcaggtgaaggtggcgttgtcgccctcggtcaccaccagcagggcggggctgaaggtgggggggttccagggccggtcggggctgtccaggaaccagccgggccgccagcccagctgcagcacggcccacaccacgggccagggggcctgggggatctgcatggatccagcttgggtctccctatagtgagtcgtattaatttcgataagccagtaagcagtgggttctctagttagccagagagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacgcgtatatctggcccgtacatcgatcatcgatgaattcgagctcggtacccggggatcctctagaccggcttcccggtatggtaattagaaacttttaataggcggtcccggccgccatccccgcgcatggtaattagcaacttttaatgggccggcgttcccgctcgcggtaattagcagcttttaacgggccgccattcccgcttatggtaattaaaaacgttcggacggcccctcgctccccgcgtaattactccctcggggttccgggttatgctgattactttcttggcagaacacgcagagcctcgcgcgccgccgggtgggtgggctgatcggcccctattggtcccctgggcttcctagtatgctaatgaatttctccccgggggcgggcaccactcagggccgcgccggcggggcgccggggggactcccatctgcgtcggcggggggcggcgcatgctaatggggttcttggagtacacccggttggtccccggggacggggccgccccgagagggggggattccctccctccgcccccgccggggcgcgcggctattgggggaatcgtaaatgccgcccctttgggggagtggataggcgccgggtataaggcagccccgtgtgacggtcgggccgcattcgcaccccggcactgcgagcgacggagcggcggcccggcgggaggaggagacccggagagacagagactaaaacccggcaagagagagaccgcgggccgccgtctcgagtctaccctaccccggctcatggaaccccggcccggcacgagctcccgggcggaccccggccccgagcggccgccgcggcagacccccggcacggtgagagggcgacccccgggtctcaggcccccccttttccccggaccacccggctgcgggttgggggtggtcgcgggcggtgggctcgggggcggggacgcttgacggggccgacccccggcccgcttaagcggtcgggggacccccgtgggccgtgcgccgccccccgaccctctgggggggcgagggaggcagggaggagcccgagagcgggggacagggggggagacgaggggtcggaatccaaaggacgcagaccacctttggttacggacccctttctcccccccttccgaacaaaaagcagcgggcggggggccggggtgagggagggacacgggggacacggcgcgggggtcccgcctcacgccccgcgccctctaaatcccccccgttgctttgtcaagcagcccgccgccccgcacgcctgggggatgctcaacgacatgcagtggctcgccagcagcgactcggaggaggagaccgaggtgggaatctctgacgacgaccttcaccgcgactccacctccgaggcgggcagcacggacacggagatgttcgaggcgggcctgatggacgcggccacgcccccggcccggcccccggccgagcgccagggcagccccacgcccgccgacgcgcagggatcctgcgggggtgggcccgtgggtgaggaggaagcggaagcgggaggggggggcgacgtgtgcgccgtgtgcacggacgagatcgccccgcccctgcgctgccagagttttccctgcctgcaccccttctgcatcccgtgcatgaagacctggattccgttgcgcaacacgtgtcccctgtgcaacaccccggtggcgtacctgatagtgggcgtgaccgccagcgggtcgttcagcaccatcccgatagtgaacgacccccggacccgcgtggaggccgaggcggccgtgcgggccggcacggccgtggactttatctggacgggcaaccagcggacggccccgcgctccctgtcgctggggggacacacggtccgcgccctgtcgcccacccccccgtggcccggcacggacgacgaggacgatgacctggccgacggtgagggcgggcgggggtcgggcgggggtcgggcgggggtcgggcgggggtcgggcgggggtcgggcgggggtcgggcgggggtcgggcgggggtcgggcgggggtcgggcgggggtcgggcgggggtcgggcgggggtcgggcactaaccgggggctcccgtctctgtctccctctgcagtggactacgtcccgcccgccccccgaagagcgccccggcgcgggggcggcggtgcgggggcgacccgcggaacctcccagcccgccgcgacccgaccggcgccccctggcgccccgcggagcagcagcagcggcggcgccccgttgcgggcgggggtgggatctgggtctgggggcggccctgccgtcgcggccgtcgtgccgagagtggcctctcttccccctgcggccggcggggggcgcgcgcaggcgcggcgggtgggcgaagacgccgcggcggcggagggcaggacgccccccgcgggacagccccgcgcggcccaggagccccccatagtcatcagcgactctcccccgccgtctccgcgccgccccgcgggccccgggccgctctcctttttctcctcctcctccgcgcaggtgtcctcgggccccggggggggaggtctgccacagtcgtcggggcgcgcggcgcgcccccgcgcggccgtcgccccgcgcgtccggagtccgccccgcgccgccgccgcccccgtggtgtctgcgagcgcggacgcggccgggcccgcgccgcccgccgtgccggtggacgcgcaccgcgcgccccggtcgcgcatgacccaggctcagaccgacacccaagcacagagtctgggccgggcaggcgcgaccgacgcgcgcgggtcgggagggccgggcgcggagggaggacccggggtcccccgcggcaccaacacccccggtgccgccccccacgccgcggagggggcggcggcccgcccccggaagaggcgcgggtcggactcgggccctgcggcctcgtcctccgcctcttcctccgccgccccgcgctcgcccctcgccccccagggggtgggggccaagagggcggcgccgcgccgggccccggactcggactcgggcgaccgcggccacgggccgctcgccccggcgtccgcgggcgccgcgcccccgtcggcgtctccgtcgtcccaggccgcggtcgccgccgccgcctcctcttcctcctccgccgcctcctcttcctcctccgccgcctcctcttcctcctccgccgcctcctcttcctcctccgccgcctcttcctcctccgccgcctcctcttcctcctcctcctcctccgcctcttcctctgcgggcggggctggtgggagcgtcgcgtccgcgtccggcgctggggagagacgagaaacctccctcggcccccgcgctgctgcgccgcgggggccgaggaagtgtgccaggaagacgcgccacgcggagggcggccccgagcccggggcccgcgacccggcgcccggcctcacgcgctacctgcccatcgcgggggtctcgagcgtcgtggccctggcgccttacgtgaacaagacggtcacgggggactgcctgcccgtcctggacatggagacgggccacataggggcctacgtggtcctcgtggaccagacggggaacgtggcggacctgctgcgggccgcggcccccgcgtggagccgccgcaccctgctccccgagcacgcgcgcaactgcgtgaggccccccgactacccgacgccccccgcgtcggagtggaacagcctctggatgaccccggtgggcaacatgctctttgaccagggcaccctggtgggcgcgctggacttccacggcctccggtcgcgccacccgtggtctcgggagcagggcgcgcccgcgccggccggcgacgcccccgcgggccacggggagtagggggagctaacactcggcttgctgcccaaagggaagccgccccccaccggaccaccggccgaggcgcctcgggggcagggggaggtgggggggaaagacggggaggagacaggaagtgggggtgggagtggggggggacggacacggccccgaacagcaacacacaccagcattttgttatggactttctggccttgttgaaaacttgaggaaaaaaaactttatatttataaaaattttacaataaagttttgtgatgcttttgacacactttgttgttggcctttgatgcagctcccccgcgcaggggggccggggatggggggggggaaagggaggaggaggagggggggcgggcacgagaagccgcccccacccccgaggcctgttggtctttatgatagaacagagccggggcccggcctgcgttctggctccctgtcttggtgggtgggcgggctggctggcgggtaaaaaaagagtgtgtccgtgttgacagggaggggggcccgatcgtgcagagcacgcacgtctggccggccagaccctgggggtggtgggcaggagtgggagggcgcctggctcggggagggaggagggggggggtcagccgcaccaccggcgcgaagccaggggccagggaactttgatagagagggggggaaagtggggcgggggcgagggcggttgaatcacaacgcatgcacgccctctgcccccggggacgggtgggaggaaggaggagggagaagagaagacccgaggcatgcacccgcacttacgcccgtgcccacccccgccccggcgcccaccccgcccgcacacctgcccgccacgcccgcccctcctcaccctggctgggagaaaggaggaggagcaggaagaggagacccgaggcatgcaaccgcactcaccccaccccgcccgcacacctgcccgccacgcccgcccctccttaccctggctgcggggagactcccatcggggcgagggggctcgcgcgttcgcaacaccacaccacaccacacggcccaccacaacacggcccaccacgacacaacacgacacgacgcgttttgcggggcatgcaagtcgacacaccgcgcgcgtgcctacctttccctagcggccccggcccccggcccgtttccttccgccaccactaccaccacccccccgcccgcgcccacgcggtagaggaaggggacgggcgccacacccacggctgtggctgggcacgcgcctttggggttgttgggggggggtgaccggcgcgtgggggcggtgggcgtatgggcccgacccgcgcctgccccccctgggaacgacgcccccggacgacaccacgggggggggaaacgggggtgggtggaagggaagaggaaggagaaagggggggtggatccgaacacgccggatccgcgaaaataataacaaaacaaacaaaaacagaaacaaaaacaaaaacacctagaaaaaaaggatacgggttggctcgcgggcggtgcggctgacctgcctgccctttctgggacccccgcctcgtgtttcttgaaagggggaggaagaacagttctcccccaacccctgctctcttctctcttccgcccgccccccccccctctcccgccgcctcagcagaagctcacctgtacgaccctaaacctacctgcgagaacgcgcggcgttcgaggggcgcgctctctcacacgagacacacgcaggcgccccccccccccggagcctgggtcccccggcggacggctcacgcggcgcggcgtctcggtgggacgcgggcagagggcggcggcggcgggggggggggggaaatgtgaggagagcgagacagagagagagaaggaagagggaaggggcgcggcgggacgggggaagacgaggagaagggaaggggcgagggtcgggcccgggagcggggcggccgggagggagaagaaacggaacgcggaaacgccgccggcgcggcccggggccccggggcccccgcgctccgccgggggcccgggccggaccgccgggcgggggacgccttccgcccggcgccgggcggctacccgggacccccggccgggaatcgaaaaaagcctccgggggcccctttcgcgcctttcgcgaacgcgcggcgccggagggggcggccgccgaggtgcgggggcccctccggccggggcgcacctcggcggccaagccccggcccgcccgggggtccccgaggcagaggcggaccctcggaggcgcggaagaagacgggaggcgggggaaaaaagggggaagagagggggaggtagggaggggagaggagaagggcgcgccggtgcgcggagcagccttccttctccggagtccctctcgatcggcggcgggcccctgcgttcgttgctgccgcgcccccggttttataaagacagggatgacgcagcagaaatgcccacagcaacacgcgggcggggctcgggctctccggcggcttaatggatctccgggcacggcgcccgcaaccgcagagcactcagctggcgcgcccccccccaacgtgggagtgtttaatggaagggcgtggggccggccgccggatgcccgcgggggcctaatgcggcgggaggcgtgggccgctggcgccgcggcccgtctgctggcccgcggcccgtctgctggcccgcggccacgtaaacaatgacacaggggttctctccgccgcggccggcgcggggcgttgccggcccggcccggccccggagcccgcggcgctgctcggctgcggccgcgggctccgggggctccgcactctgcccggctcgccccgtcccccctcttgctgcttttccgcgcgcctctctttcccgttgctttccctctccccccccccccctctctctctctctctctctctctccgccatcctcccgcccggccgcccactccccgctcggcctctccggctgcggtgcttgggtctccttcgtcgggcggcggggggggggcgtcgggactcgcggagggccggagaatggaaggcgaggggatgcaggaggaggatcgggactccccatcttctgcccttccatcctccgtttttccgctttccaccgccgccgccaccacccccccttccttcgcccgcccgcctcgccccggacccctcccccccgtgttccccccatcgttcaccaccacgccccccaccgcgccttggctgtttggggggtggcggcggtggtcggcgtgctgccggaggctgcgggcgcggggtaggtgggtgggcgggtggtgggggggggcccggctgcgtctcgccgcgatcccgccggtggggcgcggcggcggtcggggtggggggagagtgtcgtgggtgtgttttcgtgtcccccaccaccactcccaccccgaccgccgccgcgcccgcgtttctgccgcccgcgcgctcctgtgtggaccccggggtgggcggcggggggggggtgccgtgggtgtggcggcggggcgcgggccggggccggggctcgctggtccgccgaagtaaagaaaagatcgccaccgtgtgttcgtctgtgtgttctgcgcggcgccggggcccccctgccgggcggggcggtggggcggggccggggtcgcggcggggaaggaaggaaagaccccggaagcgccgggagggggcgccggcgcgacgcgggcggccgggcgggggcgcgcggcggccgggcgggggcgcgcggcggccgggcgggggcgcgcggcggccgggcgggggcgcgcggcggccgggcgggggcgcgcggcggccgggcgggggcgcgcggcggccgggcgggggcgcgctttccccgcgtcgcccctcgggttcccaagacctatcacgtgtgcgcaggggaggggaggacgcgggggaggggaggacgcgggggaggggaggacgcgggggatatataaagcggtagaaagcgcgggaatgggcatattggacccgcgtgattcggttgctcgcggttgtcttgtttggacgttttttatgcgggaacaagggggcttaccggttacactgtccgctcgctatggggttcgtctgtctgtttgggcttgtcgttatgggagcctggggggcgtggggtgggtcacaggcaaccgaatatgttcttcgtagtgttattgccaaagaggtgggggacatactaagagtgccttgcatgcggacccccgcggacgatgtttcttggcgctacgaggccccgtccgttattgactatgcccgcatagacggaatatttcttcgctatcactgcccggggttggacacgtttttgtgggataggcacgcccagagggcgtatctggttaacccctttctctttgcggcgggatttttggaggacttgagtcactctgtgtttccggccgacacccaggaaacaacgacgcgccgggccctttataaagagatacgcgatgcgttgggcagtcgaaaacaggccgtcagccacgcacccgtcagggccgggtgtgtaaactttgactactcacgcactcgccgctgcgtcgggcgacgcgatttacggcctgccaacaccacgtcaacgtgggaaccgcctgtgtcgtcggacgatgaagcgagctcgcagtcgaagcccctcgccacccagccgcccgtcctcgccctttcgaacgcccccccacggcgggtctccccgacgcgaggtcggcgccggcatactcgcctccgacgcaactagccacgtctgcatcgcaagccaccctgggtcgggagcaggacagccgacccgtctagcggccgggtcggctgtccagcgtcgtcgccctagaggctgtccgccgggcgtgatgttttccgcatctacgacccccgaacagcccctggggctgtcgggcgatgcgacgccgcccctgccgacttccgtgcccctggactgggccgcgtttcggcgcgcgtttctgatcgacgacgcctggcggcccctgttggagccggagctcgcgaaccccctaaccgcgcgcctcctcgcggagtatgaccgtcggtgccagaccgaagaggtgctgccgccgcgggaggatgtgttctcctggacgcggtattgtacccccgacgacgtgcgcgtggttatcatcgggcaggacccgtaccaccatcccggccaggcgcacggcctggcgtttagcgtgcgtgcggatgtgccggtgcctccgagtctacggaacgtgctggcggcggttaaaaattgttaccccgacgcgcgcatgagcggccgcggctgcctggaaaagtgggctcgcgacggcgtgctgttgttgaacacgaccctgaccgtcaagcgcggggcggcggcgtcccactccaagcttggatgggaccgttttgtgggcggggtggtccgacggctggccgcgcgccgcccgggcctggtctttatgctctggggcgcccatgcccagaacgcgatcaggcccgaccctcgccaacactacgtcctcaagttttctcacccgtcgcccctctccaaggtcccgtttgggacgtgccagcatttcctcgccgcgaatcgctacctcgaaacccgggacattatgccgatcgactggtcggtataagatgccgacatccggggtcttgatttacgagggggcaattaataaagactgttgatggttaaatctcgggtctcataccggtccgtgatgtcgggcgtgggggaagagagggtcccctctgcgtttactatccttgcctcgtggggctggacgtttgcaccccagaaccatgatcctggcgcgtcgccgaatacgacgcccatagagtcgattgcggggaccgcaccggacgcgcacgtggggcctctcgacggagagccggaccgggatgcgatctccccgcttacgtcgagcgtggccggcgacccgccgggggcggacggcccctacgtcacctttgatactctgtttatggtatcttcgatcgacgaactggggcgccgccagctcacggatacgatccgtaaggacctgcggctgtcgctggccaagttcagcatcgcgtgtaccaagacctcgtcgttttcggggacggccgcgcgccagcgcaagcgcggagcaccgccgcaacgcacatgcgtaccacgcagcaacaagagcctccagatgttcgttttgtgcaagcgcgccaacgccgcgcaggtgcgcgagcagctgcgggcggttattcggtcgcgcaagccgcgcaagtattacacgcggtcctcggatgggcggctctgcccggccgtccccgtgtttgtacacgagtttgtttcgtccgaacccatgcgcctccatcgagataacgtcatgctgtctacggaaccagactaagcacccccgccgtcccctttcttttccccctacccttccccccgttactgatgtgttgtgacgtttcaataaataacacgtagcttattttgttggatgatggattgattgattttattgaccgttcgttcgcccggcggtgccgtcgccgcgcgcagagggaatatgcaagcgggcggggtggggaggaaagaaggtttcaggttccgggggttgggtctgcgtcgtccagggtggggctgatctgaatttcccgcagaacctcgaccagtaggtctgttgtgtttgctgggaactcgcccgccgttggggatacgggggcggggggtgtggtcgggcggacgtccaggggtgcgttatcgcacccccgcgccgcctcgggggccgtcccgtagatcgttgcggtgatgtagatggtgtccggggtccacaccaccgtcaggatgccggccgtcgcactccggacgctttcgccgtgcgatgagctgacccaggagtcaaaggggtacgcgtacatatgggcgtcccaccagcgctccagcctctgggtactagcgcgtcctataaagcggtatgcgcaaaattcggcacgacagtcgataatcaccagcagcccgatgggggtgtgttgtatcaccacgcctccgcggggcaggcggtcctggcgcgctcgaccccgcgtcagaaccgcgcgcgtccctgactcaaacacgtgcaccacctgtgccgcgtccggcagcgcgctcgttagcgacgccctggggtgatgtaggctgtacgcgatggtcgtctgggggttccccatgtctcgggggggtgggggtgaatgtcacccggcccgggtgcggtgggaacgcgagggaatggagggttaatagacaatgaccacattcggatcgcgtagagcagatagtatgtgctcgctaatgacgtcatcgcgttcgtggcgctcccggagcgggtttagattcatgtgcaggaactcggatgaggtggtgcgggacatggctacgtacgcgctgtttaggcgcaggtttccgggcgtgaagcatatggcgaccttgtccagactgagcccctgggagcgcgtgatggtcatcgcgagtttggagctgatgccgtagtcggcgttgatggccatggccagctccgtggagtcgatcgactcgacaaactcactgatgttggtattgacgacagacatgaagccgtgctggtcccgcaggacgatgtagggcaggggggactcctccaagaactcggccacgccggccgtcgcgtgccgccgccgcagctcctccgcgaacgcgaacacccgggtgtacgtgtaccccatcagcgtgtagttgtccgtctgcagggccacggacatcagccccccgcgcggcgagccggtcagcagctcgcagccccggaaaatgacattgtccacgtaggtgctgaagggggcgctctcaaacacctccccgaagagctcccgtaggataaggtatcgccccagaaaggccctcttcaggagcccaaactgggcgtggacggccgcggtggtctcaggctcttcgagggcgtagtggcagtagaacacgtccagctgctgttcgtccagcccggcgaagataacgtcaaggtcgtcgtcggggaagtcgtccgggcccccgtcccgcgggcccaggtgcttaaaattgaacgcacgctcccccggagagcggtcgctggtgtcggcggccctggttgccgatgcgccggcggcgtcccggcgtagcgacaggagttctgccgtcagctcccctaggcggccgtaggccagggtcctctgggtcgcgtccaggccggggcgctggagaaagttgtaaaagtgaatcagcccgccgaacatgagccgcgacaggaaccggtaggcgaactccaccgaggtctccccctgggtcttcacgaagctgtcgtcgcgcagcacagcctcgaaggtccgaaacgtcccgtcgaacccaaacaccatctttcggaggcgcgcggtcaccgcgacctggctgttgaggacgtacgtgatgtcgttccgggccacgactagctgttgcttgctgtgcacctcacagcgcacgtgccccgcgtcctggtcctgactctgggagtagttggtgatgcgactggcgttggccgtgatccacttttccatggtcagcgtgggttgctgcgtgagccgtcgatactcgtcaaactctttgaccgacacaaacgtgagcacggggagggtaaacacaacaaactccccctcgcgagtcacctttaggtaggcgtggagcttggccatgtacgcgctgacctccttgtgggacgagaacagccgcgtccaccccggaaggttggccgggttggtgatgtaactttccgggacgacaaagcggtccacaaactgcatgtgctcctcggtgatgggaaggccgtactccagcaccttcatgaggttcccgaactcgtgctccacacatcgcttgttgttaatgaaaatggcccagctgtgcgagaggcgcgtgtactcgcgtagggtgcggttgcagatgaggtacgtgagcacgttttcgctctgccggacggagcatcgcagtttttggtgttcgaaggtggactccagcgaggccgtctgggtcggcgaccccacgcacaccagcaccggccgcaggcggcccgcgtactggggggtgtggtacagggcgttaatcatccaccagcaatacaccacggtcgtgagtaggtgccgccccaggagcccggcctcgtcgatgacgataatgttgctgcgggtgaaagccggcagcgccccgtgtgtgaccgaggccaggcgcgtgagggcaccctggcccagccccaaagtctgctctagggcggtgagggcgtggaactcgtttcgcgcgtcttcgcccccgtgcgccgccagggcccgcttggtgatgtcgaggatcacctcccagtagtacgtcaggtctcgccgctgcaggtcttccagcgaggcggggctgctggccagggtgtacgggtgctgccccagctgggcctggacgtgattcccgcgaaacccgaactcgtgaaagatggtgttgatgggtcgactcagaaacgcccccgagagcttaacgtacatgttctgcgccgcgattcgcgtggcgcccgtgaccacgcagtccaggacctcgttgagggtctgcacgcacgtactctttccggatccggcgttgccggtgatgagatacgccgcgaacggaaactcccggagcggcaggccggtcgggacctccaaggccgccacgtcccggaaccactgcaggcgcggcacctgcgtgacgtcgagctgctgctgcgagagctctcggatgcgtgcgatgattggttggaccccgtgcatggacgtaaaatttaaaaacgcctcgtccctgaaccgcacggcgggtctggccccgggctgctgtgggggcggacctggtgcccggacgtcccgcgagccctccccgccggacgccgccatggccgcacagcgcgcgcgggcgccggcgatgcggacgcggggcggcgacgcggcgctatgcgcccccgaggacggctgggtgaaggttcaccccacccccgggacgatgttgttccgcgagattctcctcgggcagatggggtacaccgagggtcagggggtgtacaacgtcgtccggtccagcgaggccgccacccgacagctgcaggcggcgatcttccacgcgctcctcaacgccacgacgtaccgggacctggaggaggactggcgccgccacgtggtggcccgcggcctccagccgcagcggctggttcgcaggtaccggaacgcccgggagggcgatatcgccggggtggccgagcgggtgttcgacacgtggcgatgcacgctcaggacgacgctgctggactttgcccacggggtggtagactgctttgcgccgggcggcccaagcggaccgaccagcttccccaaatatatcgactggctgacgtgtctggggctggttcccatattgcgcaagacgcgcgagggggaggcgacgcagcgcctgggggcgtttctcaggcagcacacgctgccccggcagctggccacggtcgccggggccgcggagcgcgccggcccggggcttctggatctggccgtcgcgttcgactccacgcgcatggcggaatacgaccgcgtgcacatctactacaaccatcgccggggggagtggctggtgcgcgacccggtcagcgggcagcgcggcgagtgcctggtgctgtgcccccccctgtggaccggcgaccgcctggtcttcgattcgcccgttcagcggctgtgccccgagatcgtcgcgtgccacgccctccgggaacacgcgcacatctgccgtctgcgcaacaccgcgtccgtcaaggtgctgttggggcgcaagagcgacagcgagcgcggggtggctggcgccgcgcgggtcgtcaataaggcgctgggggaggatgacgagacgaaggccggctcggccgcctcgcgtctcgtgcggctcatcatcaacatgaagggcatgcgccacgtgggcgacatcaacgacacggtacgcgcctacttggacgaggcgggggggcacctgatcgacacccccgccgtcgaccacaccctccctgggttcggcaagggcggcaccggccgcgggtcggcgccccaggacccgggggcgcgaccgcagcagcttcgccaggcgtttcagacggccgtggtcaacaacatcaacggcatgctggagggctatatcaataatctctttggaaccatagaacgcctgcgagagacgaacgcgggtctggcgacccagctgcaggcgcgcgaccgcgagctgcggcgcgcccaggcgggggcgctggagcgggagcagcgcgcggcggaccgggcggccgggggaggcgcgggccgcccggcggaggcggatcttctccgggccgactacgacattatcgacgtcagcaagtccatggacgacgacacgtacgtggccaacagtttccagcaccagtacatccccgcgtacggccaggacctcgagcgcctgtcgcgcctctgggagcacgagctggtgcgctgcttcaagattctgcgccaccgcaacaaccagggccaggaaacgtcgatctcgtactctagcggggcgatcgcctccttcgtggccccgtatttcgagtacgtgcttcgcgccccccgagcgggcgcgctcatcaccggctccgatgtcatcctaggggaggaggagttatgggaggcggtctttaagaaaacccgcctgcagacgtacctgacagacgtcgcggccctgttcgtggcggacgtacagcacgcggctctgccccggcccccctccccaacccccgccgatttccgggcgagcgcgtccccgcggggcgggtcccggtcccggacccggacccgatcccggtcgcccgggagaacgccgaggggtgcgccggaccagggctggggcgtcgaacgcagggatggccgaccccacgcccgccgatgagggaacggccgccgccatcctcaaacaggccatcgccggggaccgcagtctggtcgaggtggcggaggggatcagcaaccaggcgctgctgcgcatggcctgcgaggtgcgccaggtcagcgatcgccagccgcggtttaccgcgaccagcgtcctgcgcgttgacgtcacccccagggggcggttgcggttcgttctggacgggagttccgacgacgcgtacgtggcgtcggaggattactttaagcgctgcggggaccagccgacgtatcgcggttttgcggtcgtcgtcctcacggccaacgaggaccacgtgcacagcctggccgtgccccccctcgttctgctgcaccggctctccttgtttcgccccacggacctccgggacttcgagctcgtctgcctgctgatgtacctggagaactgtccccggagccacgccacgccctcgctgttcgtcaaggtgtcggcgtggttgggggtcgtggcccgccacgcgtctcccttcgagcgcgtccgctgccttctcctccgcagctgccactggatcctgaacacgctaatgtgcatggcgggcgtgaagcccttcgacgacgagctagtcctgccccactggtacatggcccactacctgctggccaacaatccgccccccgtcctctcggccctgttttgcgccaccccgcagagctctgcgttgcagttgcccgggcccgtcccccgcacggactgtgtggcctataacccggccggcgtcatgggaagctgctggaattccaaggacctgcgttcggctctggtgtattggtggctttcggggagccccaaacgacggacctcgtcgcttttctatcggttttgctaactccggaaaataaacgtgttttttatggaacgttccccacctgtcgtgtcatctctcgggggatggtggtgggcctgtgtgtgtgtcttgtgcaccgaaggaggaaagtgggggggtggtggtgctggtggtggaaagacatgatagagggaacaaagaaatagaagaaaaccacaaccggcgcgtgccagtaaatacggacgcgcgcacacgcggggggtaagttggagcacggggccccggtttattgaccaaattcagggaaacagaaaccgcatcttttcctcgaaagggtacacaaagctcccgccctcgccccacacgccttccagaacccccgtaaacaccagttgaatctcgcgcaggatctcgcgcaggtgatgggcgcagtccacgggggggagcaccaagggccgcgggtacagatccacggggacgccgaccgactccccgcccccgggacatacgcgcacgacgcgtctccagtattgctccgcgtccagcagggcgcctccgcggaaggccgtttggggcagggggtcgtcggcctcgcctgggggggtcagaacgctccagtactccgcgtccagacgcctcccgaaggcatccaggacaaagcggtcacaggcgtcctccatgacgccccgggccgcgcacacggcctcctccggcgggccggcggccggccgccggaggattcgtctcagcgcgtcgcgcataacctcggccgccgcggcgtacgcgggcccgcggagaggaaatccctgcaggaagtcggtgtcatcgcgggagttccagaaccacgccccggtctggctccaggtgacgacgtgggtgtagacgccctctggcgccagggagggggcgaggcgcgggcgtatgccgttggccgaaagtacggcgcgcacggacgcctcgagggcccggcgggcgtcctggatcgcgccgtgcgcggcgtccgcgtccccggggtccacgttgaacagcccccagaacgcagccccggtgccgccgcagaccgcaaacttcaccgagctggccgtctgctcgatctgcaggcagacggcggccatgaccccgccgagcagctgccggagcgcggggcaggcgtcgcacgcgtccggcaccaggcgctccagcacggcccgggcccagggctccgagggggcggccgccaccagcgcgtccagcctttccaggcccgcccgcccccgggcttccggcagcccggcctccccgaggcccgcgagggcggccaggagctgggcctggagcccggagaaacaaaaccgcgccgtccagaccggcccgacggccgccggggggtcgagtagttggatggtggtggccgtggggtgccaccgcgccaccgcttcccgaaaggcgggcaggaggcggccggccgcctccgaggccacggccggccatgcccgcgggggcaggacgaccctggcgcccaccgcgggccaggcccccaggcacgcggcatgggtggccgcggcgccccgcaccaggtcacgcgccgactcggcggcggcggcggccggcacggtaaacgtgggccagcccggaaatcccagcacggcaaagtattggacgggccctccccggacctcaaacccgggccccagaaaagcgaagacgggggccagggctccgggggcggcgtggaccgtggtatgccactgccggaagagggcgaccagcgccggggcggagaacccgtcgccggcgctcacgaagtagtcgtagccgcgcggcagcagcacccgcgccgtgacccgctgcgggtgtccgcggggccgcaggccgacctcgcacacctcgaccaggtccgcgaaggcgccctccttcctggtcggcggaaacgccagggtggtgtattcgcgcgcaaaacgcgcggtcctcgtcgtgatggtgacggcgagcgaggcggaggacgcgcactgggggctgtcgcgaatggcggccaggcgcgcccacgccaaccgcgcgccggggtgctcggcgacgcgcgcggacagggccagcgggtcgacgtcgaccttggcctccacgtccaggagggcggcgcgaggagcggccggcgggccccacgacgccctttcgaccctcacgaccagacccgtctgcgggtcccagcccaggcgcagcgggacgaagagggccaccggccccgtctggcgctccagggccgccagaacgcacgcatacagcgcccgccacagggtcgggtcccccaggggctccagcggggaggcggccggggccgtcgcggcgcgggcggccgcgacggccccggcggccgagacgtcgggggagccgtagaagtcctgcaggtcggacgaaccaacggacacctccgcgaagcgcgcgcgcgcctcccccgcggcgtcgcgacagaccagatacagcagggcgtggaggcagtcgcgcgtgcgcgggggcagccataccgcgtatagggtaatggcgctgacgctctcctccacccaaacgatgccgggggcttccatgccacgacgcccgggggttgccgtgtatcgaacgagcgcggccccagacttatagggtgctaaagttcaccgccccctgcatcatgggccaggcctcggtgggaagctccgacagagccgcctcgagaatgatgtcagtgttgggctgggcgccggaggcgtgcgtgcgcaagcagcgcccccacgcgggcgcgcgcagcttgaagcgcgcgcccgcaaactcccgcttatgggccatcagcagcgcgtacagctgtctgtgcgtccggcaggcgctgtggtcgatgcggtgggcgtccagcagctccacgatggctcgcttggtgaggtttttaacgcgccccgccccgggaaacgtctgcgtgctcttggccagctgcaccccgaacagttcgccccagatgatcttgaacagcgacagcgcgtgctccgtctcgctcacggacccgcgcggggggcagccgctcagggcgtcggccacgcgcttaaccgcgtcctccgacagcaaggggccgtcggtcacgttacagtggcccagttcgaacaccagctgcatgtagcggtcgtagtgggggttcagcagctccagcacgtcctcggggctaaaggttcgccccgaccccccggccatcgagtcccactgcaggcacgcggccatggtgctgcacagacggaacagctcccagacgggggcgacgtttagggtggggtgtagggccacaagctccagctctccggcggcgttgatcgtggggatgacgcccgtggcgtagtggtcgtaaagccgccggaagatggcgctgctatgggcggccatggggacgcgaagacaggcctccagcagcaccaggtagatgaaccgcgtgcggccgaccaggctgttgaggccgcgcatgagcgcgaccacctcggccggcgcgacgtccggccggaggtacttttcgacgaaaaggcccacctcctccgtctcggcggcctgggccgacagggacgtgtcggggtcctggcagcgcagctcccgcagatcccgctgggccctcagggcatcaaaatgtatcccccgcaaaaacagacaaaagttcctcggggtcagcgcggcgtcgtggccccagaaccgcacgtgcatgcagttgagggtcagaagcatgtggaggatgttaagactgtccgcgaggcacgccagcgtgcacctctcgaagtagtgcttgtaccggaatttgctgtagatgcgcgacccccgcgcctgcgccgcgtcggcgtgcgacgcgtcgcagcgccctttgaaccggcggcacaacaggttcgtcacctgggaaaactgtgccggccactgcccgctggcgctcaccacgtggttgagcagcatgggcgtaaagacgggctccgagcgcgccccggacccgtccatgtagatcagcagctcccccttgcggagagtccgtacccgccccagcgactggtacacggacaccatgtccggcccgtagttcatgggtttcacgtaggcgaacatgctgtcaaagtgcggcggatcgaagctaaggcccaccgtcacgaccgttgtgtagatgaccacccggtaccggccccatgtggtcacgtcgccgggcggggtgagcgagtggagcagcagcacgcggtccgtaaactgccggcagaacctggcaacgacctccgcgaaggagaccgtcgacgagaagatgcagacgttatctccgccggccaggcgcgcctccagctccccgaagaaggtggcgtccgggggggcgtccggggggggcgccccgcccgccggccccggcgggcgcagggccgcctgcaggacctcgggccccaggcgcgggagaaacagacaacggcgcgccgaaaatccgggcatggcgtactccccgatgaccacgtgaacgttcttttcgccccggaggctgcacagaaagtccaccagctgcgcgttggcggtggcgtccatggcgatgatccgcgggcacgtgcgcagcaggcgcagcatcaacgcgtcgacgcggcccagctgctgcatcgtcggcgagtacagttggcccaacgtcgacatgacttcgtccaggacgagcacgtcgtagttgttcaacaggttcgggcccacgcgatgaagactttccacctgcacgatgagacggtggaaggggcggtcgttcatgatgtaattggtggatgagaagtaggtgacgaagtcgggcaaccctgactcagcgaaccgcgtcgccagggtctgagtaaaactccgacgacaggagacgaccagcacactcgtgtccggagagtggatcgcttcccccaaccagcggatcagcgcggtagtttttcccgagcccattggcgcgcggaccacagttacgcaccgggccgtcggggcgctcgcgtccgggaaggtgacgggtccgtgttgctgccgctcgatcgttgttttcgggtggacccggggaacccactcggccaaatcccccccgtaaagcatccgcgccagcgatacactcgacgtgtactgctcgcactcgtcatccccgatgggacgccgggcccccaggggatcccccgaggccgcgccgggcgccgacgtcgcgcccggggcgcgggcggcgtggtgggtctggtgtgtgcaggtggcgacgttcatcgtctcggccatctgcgtcgtggggctcctggtgctggcctctgtgttccgggacaggtttccctgcctttacgcccccgcgacctcttatgcgaaggcgaacgccacggtcgaggtgcgcgggggtgtagccgtccccctccggttggacacgcagagcctgctggccacgtacgcaattacgtctacgctgttgctggcggcggccgtgtacgccgcggtgggcgcggtgacctcgcgctacgagcgcgcgctggatgcggcccgtcgcctggcggcggcccgtatggcgatgccacacgccacgctaatcgccggaaacgtctgcgcgtggctgttgcagatcacagtcctgctgctggcccaccgcatcagccagctggcccaccttatctacgtcctgcactttgcgtgcctcgtgtatctcgcggcccatttttgcaccaggggggtcctgagcgggacgtacctgcgtcaggttcacggcctgattgacccggcgccgacgcaccatcgtatcgtcggtccggtgcgggcagtaatgacaaacgccttattactgggcaccctcctgtgcacggccgccgccgcggtctcgttgaacacgatcgccgccctgaacttcaacttttccgccccgagcatgctcatctgcctgacgacgctgttcgccctgcttgtcgtgtcgctgttgttggtggtcgagggggtgctgtgtcactacgtgcgcgtgttggtgggcccccacctcggggccatcgccgccaccggcatcgtcggcctggcctgcgagcactaccacaccggtggctactacgtggtggagcagcagtggccgggggcccagacgggagtccgcgtcgccctggcgctcgtcgccgcctttgccctcgccatggccgtgcttcggtgcacgcgcgcctacctgtatcaccggcgacaccacactaaatttttcgtgcgcatgcgcgacacccggcaccgcgcccattcggcgcttcgacgcgtacgcagctccatgcgcggttctaggcgtggcgggccgcccggagacccgggctacgcggaaaccccctacgcgagcgtgtcccaccacgccgagatcgaccggtatggggattccgacggggacccgatctacgacgaagtggcccccgaccacgaggccgagctctacgcccgagtgcaacgccccgggcctgtgcccgacgccgagcccatttacgacaccgtggaggggtatgcgccaaggtccgcgggggagccggtgtacagcaccgttcggcgatggtagccgtttcgttcgttttaataaaccgacgttgtgcgtttcaccatacttcggcgcgcgtgtgtgtgtgtttttttttttgtggtgtttattttccccccaccccttccttttctttcggccaccacccccctcctcccccgtactatacaacaaaaaataccacacatacgaccaaatacggacaatcatttctgtctttattcgctatcagagagtgggggcgtgagcgtggcaggagggcgggccacgtcggggtcccgccgtctggtgtgacgcgatggggggtccgatgcgcgccggtactggggccccggcgcccgggtgaccacgcgcacgtcggggggcacgtagaagttaccctcttcttcggactcgatgtccacgacgtcaaattcgtgggcggtcagcgagacgacctccccgccgtcggtggtgatgacgttgtgtcggcagcagcagggccgcgccccggagaacgcgaggcccataacttggcgagcgtatcgtcgaaggccaggcggctgtttcgccggatgtcccggtagatccccggctcgacgcggacgggggtgatgatcagggcgatcggaacggcctggtccgggaggatcgatgccttggcgggtccgggggccccgccacgcccggcgggcgctccgcggccgtcctccaggcggaacgtcacgccctcctccgcgcccgcgcggtgcctgccgaggaacgtcaccaggtgcggttgcagggggcagtcgggaaagtggctgtcgaggacgtatccctgcaccaagatctgtttgaagttcgggtggcgggggttggcgaagatgggctcgcggcgaaccagctccccggagctccaggccacgggagagatggtgcgacgctcaaggtcggggacgccaaacagaagcacctccgagacaacgccgctatttaactccaccagcgcccgatccggggcggagcatcgccttttttcgccggcggcgcgggaatcgagccagtcccggtcttgggtgacgagcgcctcctccgggcccggaacgcgcccgggcgcgaagtagcgcacgccggggttggggatggaccggatgaacgcccggaacgcctccggcgatcgccgcgccatcaggtcctcgtacgcggaggccgcgggggcgccggggtccgcggggtcgaacgcgtacttggctcggcacttaacctcgtagaaggccaggggggtctggggggcgggggccaggtagccgtgagggtccctggggcacacgaggatgtccagggacgcccccaccatgcccgtgtggccgtccatgaggaccccgcacgcgtgcacgttctcctcggcgaggtccccgggttggtgaaagacgaagcgcccggcgtcggcgtcgtcgttgacgcccgcgtccgcgcggcccacgcagtagcgaaacagcaggtttcgggccgtcggctcgttcacccgcccgaacatcaccgccgacgactgggcgtccagccgcaggctggcgttgtgggtgagccactgggacgagaagcacggaccctgcgcgccccaccgcagcgtggaggcggtcgtcaggccccgccgaagcagggcccagagctggcagtcggcctggttttgcgtcgccgcctcgtaaaatcccataagcgggcggggggcgacggcttcggcggcggacgggggggcgcggcgcgtcaggcgccagaggtgccggccgagcccgcggtccaccatgccggccgcctccagcgacacgacgagggagcacagatagtccaggcgagcccacaggggcccgatggccagaggggagcggacgccgcgcagcaggccgcgcaggtggcgctcgaacgtttccgccaagatatgggggggcagtgcgttggggatcgccgacgccgaccacatcgggtcggggtccgggggaccggggctgcagtccgggtcgatggcgtgtgcgccccccggcgagaggggaatgtcgggggttggcgggccggatgaggcctcagagagggccggggacgcgggccgggccttttcgcccggggccccgccgtcgggttgcccacgtggggggctctggggccaatgggaacccggggcccccggtgacgtggggcggggtggggcggggcggggcccaaagacggtcgccagatctaggctgttgggtcggggccgcttcgggggactatcggggtcgcgggcggggtccgcggggcgcttggcgccgggtgttgcggcggccgccatttttacgagcagccgaagagctcgagggcggaagggatcctcacgacagagagtggcgcgcggccgggttggcgtgacagaggcgggagaccagcaccagcagcggcctcagctcgggcggcagcgacaccgacgacaggacggccttgtgcgtgcgctggtaatttatacactgctccgtgaacgcgcgccgaatcttgggattgcgaaggtggcgccggatgccctccggcacgtcatacgccaggccgtgggtgttggtctcggccgagttgacaaagagggcggggtgcagaacgcagcgataggcgaggagggccacggcaaagtccggcgagagctggttgttaaagtactggtagcccgggacgcgggtcacggggacgcccaggctcggggccacgtacacgctaaccagcagctccagcagcgtctgccccagggcgtagagatcgaccgccagcccgacgtcgtgcttcagggggcggttgttaaactcggcccgctcgttgttgaggtactttaccgagagctccggtggctggttgtacccgtgccccaccagagtgtgaaagttggccgtggtcagggcggcgggcatcccaaacccccggggggactcgaggtccggctcctggaggcaaaactggccccgggatatcgtggagttggagttcagggtcaccaggctaaagtcggccaggacggcccgccggagcgacaccgcgtccgatcgcagcatcacgaggacgttggcgcacttgatgtccaggtggctgatcccgcacctggtgttcaggaacaccacggcgcgcgccaggtctgtgaagcagtggtggagggccgtcgcgacggagggggtggtcgcgcgcagggacgccagctggccgatgtacttgccgaggtccatgtcgtacgcggggaacacgatctggcgctgctgcagcgagaacccgagcggggtgataaagccgcggatgtcgtgggtgcggccgccgcgaagagcgcactcccccacgagcagggtcgcgacgagctccacggcaaaccactctttttcccggatggtcttcacggcgagcttgtgttcgcgaatcaactgcacctcgccgtacccccccgagcccccgaagctgcgggccccggggatctccagggtcgtgtagcggagggcggggttgacggcgaatacggggatgcatagcttgtggatgcgcgcgagggacaggatgtgcgaggggggcgacgggggcgaggtcatggccgtctcggacctgcgcaggggcgggcgccttagcttggccgcagggccgggggcctcgggggacgagcggcgacgagacgagcggctcactcgccatcgggacagtcccgcgcgaagccgctcccggaagctggatcggcggcgggacccggggcgggctccggagacggcgccgtctcggggggaggggccgcttgggcgtccggacgcccggcggctgagggagtgtatgtaggacgcgagccaggccttgaaggagcgtcggtgtgcaccttgggggctgatgtcagctgccacatgactagcaggtcgctgtcgcccggactcatccatccgtccgccaggtcgccgtccccccacagagacgcgttcgccgcggcctcttcgagctgctcctcctggtccgcaagacgatcgtccgccgcgtccaggcgctcgctaagcgcgggatcgaggtaccgtcggtgtgcggttagaaaatcacgtcgcgccgcttgctcttccacgcgaattttaacacaggtcgctcgctgtcgcatcatctctaagcgcgcgcgggactttagccgcgcctccaattccaagtgggccgccttggcggccataaaggcgccaacaaacctaggatcttgtgtactcacgccctcccggtgtagctgcagggtctggtccctgtacacctcggcccggaggtgcgtctcggccaaacgtcggcgcagggccgcgtggctggcgtctcggctcatctcgccgcccccgcgcgcgcccgacgtcggactccttcgccccgacccccctgacctcagccgcccccgcctcgcccgcgatgtttggccagcagctggcgtccgacgtgcagcagtacctggagcgcctggagaaacagaggcaacagaaggtgggcgtcgacgaggcgtcggcgggcctgacgctcggcggcgatgcgctgcgcgtcccttttttggattttgccaccgcgacgcccaagcgccaccagaccgtggtcccgggcgtcgggacgctccacgactgctgcgagcactcgccgctcttctcggccgtcgcgcggcggttgctgtttaatagcctggtgccggcgcaactcagggggcgtgactttgggggcgaccacacggccaagctggagttcctggcccccgagctggtgcgggcggtggcgcgcctgcggtttcgggagtgcgcgccggaggacgccgtgccccaacgcaacgcctactacagcgtcctgaacacgtttcaggccctgcaccgctccgaagcctttcggcagttggttcacttcgtgcgggacttcgcccagttgttgaaaacctcgttccgggcctctagtctcgcggagactacgggccccccgaagaaacgggccaaggtggacgtggccacccacgggcagacgtacggcaccttggagctcttccagaaaatgatactaatgcacgcgacctactttctggccgccgtgctgctcggggaccacgcggagcaggtcaacacgttcctgcggctcgtgttcgagatccccctgtttagcgacacggccgtgcggcacttccgccagcgcgccaccgtgtttctagtccccaggcgccacggaaagacctggtttttggtgcccctcatcgcgctgtcgctcgcgtccttccgggggatcaagataggctacacggcccacatccgcaaggcgaccgagcccgtgtttgatgagatcgacgcctgcctgcggggctggtttggctcgtcccgggtggaccacgtcaagggggaaaccatctcgttctcgttcccggacggctcgcgcagcacgatcgtgtttgcctccagccacaacacgaacgtaagtacgccttcctcccgcggtgcctgtttccccggtgccgccctccccgagatcgaccgacagacaaacacagccagacgcgagtgtgggacgacacgcccgcagccccccccccgccatggcgggggggaagccttactgtttatttgtaatcggacgatgaggctctggccacggcccgcgcgaccgcggggcagctcgttgcaaacaggcggctggtatacgatgacagaacgcagaggcgccacccggcgctggtcgggcggatgacgctttccgcgccgtcccggcccacgacgacctcgtgcaggtgggccgtgatgcgcgggcggcgggtcgcctgccgcaggataaccgcgtccacggggtgcccgaagaggagctgacacaggctcgcgtccccccggacggccagggtgcgctgggccatattggaccacatgcacggggcgacgcagggacaggcctccgccacggcgggggcgcgccacagcgcgttggcggaatcgatgtgggccgtcggggcgcaggcgccgcctcctcccggggggtcggtaatcctggatagcagccatcctaaatggcgggcccggctgcccgggggacagagcgaccccaggtcatcatccatggcccagcagtatatgcggccgccggggaggtgccaccaggcccccggacccagggcacagcacgcccccggattcgggggcggttccgtgggtaccaggtaggcgccgtcgagctcgtgggccacgggctcgtccgcgagctgttcggcggcggggtcgggggtttcctccgggggggaggcagcttccaggtggccgaaggctagggtgcacagcagcggggtccgggggtgcgttacgctgcggaggtggacggtggcgcagtagcggcgctcgcggttaaagaagaaaatggcaaagaacgtgttcgaaggcaggcgcagcgccttgggccgcgtcaggtacaggaagatctcgcagaaaagggcacgctcggggtcggggtccggaagggccacctggcacagcggctcggtgaggaccgtgaggcaccgaaaaatcttaagccgctcgtccccccgaacgacgcgccacacgaagacagagttggcgatgcgcgcgacgaggtcggcttcgggccccgggtcgggggcgcgcgcgtcggggggggcgccccggtgacccggcggggccgcggctcccggggggcctggcgtcgcctggggacgccagagtgcccgctgtgccaggttggtggtggggaagggaccggagacgcaccaaaagcagaggggccagcgcgtgtatgagttggggggggggtgggtgagcggtggaacaaaagcacgcgtcagcggacaaggccgggtcccgtagccgccccgcgacagaaccggagtccgacggcacgcgcgacggggtctgcgaggctgaggtacgccgcggtgttaatggtaaacgcaaagcctcccggaaagaccactagcccgcagaggcggcgattgaacccaaggcagaggtacgcgtagctctctcccggaaggtattgctcgcagaccctgtgtggggcagtggaggggctgccctccatgaagcgacatttactctgctcgcgtccattgacgtcaccgtcaatcaccactgcgattggacggttggtgaggcgcagcgtgtctccgctggtgctgtagtagtcaaacgcgtagtgggcgtcggagtcggcgaagcgggcggggatgtcgtcgctgagagggacgagccgccgccgccgcccccgaccgccctggccgcccagatgcgccagcacggccagggcgtacgcggtgtgaaagaacgcgtcgggggcggtcccctcgagggcgcgcatcaggttctccaggagcacggggaagcgccgcgtcacctcccctagccactcgctctggtgggggccaaagtcgtagcgcaggcgctggaagatgcgcgggccgccttggagcgcggcccggatagagtggcccagggcccgcagacacgcgatctggatgcgcgcgacgaaggccacctcggccgcgatgtcaaagggctgcagcacggggcgcgggtggcgcaggggtccctcgagcgcgggaaagcgacgcagcagcgccgtctgggccgcgggggacagctggtgggggcgcacgacgcgctcggcggcacaggcctccgtcagggccgtggccagctcggaggacagccgcggggggcgggcgcgtcgcccgccccacgccaccgaattctcgtaggagacgacgacgaagcgctgcttggtcccgtagtgatggcgcaggaccacggagatggagcgacggctccacagccagtcgggccggtcgccgccggccagagcttcccacccgcggtccagccactcgaccagcgatcgcggcttggcggtccccggcacgagggtgagcacgtcgttgaggacgtcctcgcccgcggcccgggggccccccggggtggcaaagcgccccccgccgggcggctccaggcccgccagcaccgcctccgcgtccgacgcgcccagggctcccccgctgacggcctggtggaccagggcgccctggcggagccccgaggcgacgccggaggccgcgtgcttggggcgcgcgcggaccgggtggcggcgggtgacgtcctgcacggcccgctggaccagcgcgaggatctcctcgttctcttgcgtgatggacacgtcctccgcggtggccgtgtcgcctcccggggccgtgagctgctcctccggggagatgggggggtctggggtgccgacaacggccggcccggccccgcccgagaccgaggacgcctggggagtgggggtgccgctttcccccatccccagggacaggtgggccgccgcctccgtcgcggcggcgggagccgcggcccccagccgcgcgacgtagcgacaaaagtggcgacagaggcgcatgaggcgcgcgccgtcggccgcgtatcgcgtgtttggcgggacgagctcgtcgtaactgaacaggagcacgcgggcgcaggtcgcccacgggccccacgccaggcgcagcgccgcgaccgtgtacgggtcgtacacgccttgggcgtcgcacgcgaccggcagggagacgaacagcccgcccgcgctggggacgcgcggcaggaggtccgggtgcgccgggatgacgggggctaggatcgcccccaccgcatccgccggcacgtaggcggcaaacgccgaacgccacggggtgcagtcgccggtcgcgtgggcccgggtctgggtttcgacccggaagttcgcggccgccccaccgtcggggcggccgcgcacgagggcggacagcgggacccccgccgccgccaggcactcgctggagatgatgacgtgaatcagcgaggcggggctgctcgggtcccgggtgagatcgtattggacctcgttggcaaagtgcgcgttcatggcccggccggcggtgcgagcccttcccggtgccggaaggggcgtgggtggggggtgcgtgtgcgcgtcctcggggcccgcgggcgcacgtgcgcttatacgctgtgtgtttcgtctgtccccagggaatccggggccaggactttaacctgcttttcgtcgacgaggccaactttattcgcccggatgcggtccagacgattatgggctttctcaatcaggccaactgcaagatcatcttcgtctcgtcgaccaacaccgggaaggccagcacgagctttttgtacaacctccgcggggccgccgacgagctgctcaacgtggtcacctatatatgcgacgaccacatgccgcgggtggtgacgcacaccaacgccacggcctgttcctgctatatcctgaacaaacccgtgtttatcacgatggacggcgccgttcgccggacggccgatctgtttctgcccgactccttcatgcaggagatcatcggggggcaggcccgcgagaccggcgacgaccggcccgtcctaacaaagtcggcgggggagcggtttctgctgtaccgcccctccaccaccaccaacagcggcctgatggcccccgagctgtacgtgtacgtggacccggcgttcacggccaacacgcgcgcctccggcaccggcatcgcggtcgtcgggaggtaccgcgacgatttcattatcttcgccctggagcactttttcctccgcgcgctcacgggatcggcccccgcggacatcgcccgctgcgtcgtgcacagcctcgcccaggtgctggcgctgcaccccggggcgtttcgcagcgttcgcgtggcggtcgagggcaacagcagccaggactcggccgtggccatcgccacacacgtgcataccgagatgcaccgcatcctggcctcggcgggggccaacggcccggggcccgagctcctcttctatcactgcgagccgcccggcggcgcggtattgtaccccttctttctgctcaacaaacagaagacgcccgccttcgaatactttatcaaaaagttcaactccgggggcgtcatggcgtcccaggagctcgtctccgtgacggtgcgcctgcagaccgacccggtcgagtatctgtccgagcagctcaacaacctcatcgaaaccgtctctcccaacaccgacgtccgcatgtactccggaaaacgcaacggtgccgcggacgacctcatggtcgcggtcatcatggccatttacctggcggccccgaccgggatccccccggccttttttccgatcacgcgcacgtcttgagtctttcttgccgtttcttttgtttctctttctttccccccctctctccgcaataaacgccttcccggaactgtgtttccccccctacaacagtgttgtccgttggttgggtggttggggtgcgggggtgggcgggggaagcaagaaaacggtcggcgaacacaacatcgggaaaacggattcccgcacgtgcgtcttcccagattcgacacacacaccccccttctccttaaataaacacaaaccacacgctcgttggttggttaatgccagcgctttatttacgtcttgttttttttgcgtttcctccgcgggtcccttcccaacacgcctgcccccgcctcaggggtagcggataaccggggccatgtcgccggattgcacaacggcggcgccgtcgaacgtacacacccgaaccgccggggccagggccaggatgtccccgagttggcccgcgtgcgccagccaggcgaccagcgcctcgtaaagcggcagcctgcgttcgccgtcctgcatcagcatgggggcttcggggtggatgagctgggcggcttctcgcgtgacgctctgcatctgcaggagcgcgttcacgtatccgtcctgggcgctcagcgcgagcagccgggggatgagcgtgaggatgagggtggttccttcggttatggagtagaccatgttgaggacgagcgaccgcagctcggtgtttacggaggcgagttgctggacgtcggccacgagcgagagacgggccccgttgtaatacagcacgttgaggtcggggagctccccgggcgtccgggggtcggggttgaggtcccggatgccccgggcgaccagccgcgcgactatctcgcgggccaggggcgttgggagcgggaccggaaaccgcagcgtgaggtccagcgactccaggcgcacgtccgtcgcctggccctcgaagacgggcgggacgaggctgacgggatccccgttgcagaggtcgacgggggaggtgttgcggagattgacggtgccggcgtgcgtgagccccaggtccacggggcaggcgacgattcgcgtgggcagcacccgcgtgattaccgcggggaagcgcctgcggtacgccagcaacaaccccaacgtgtcgggactaactcctccggagacgaacgattcgtgcgccacgtccgcgagcgccagctggcggcggatggtcggcagaaagaccactcgaccctcgcaccgctgcagcgccgcggcatcggggcgcgagatacccgaggggatcgcgatgtctgcttcgaaacaatccgtgatcatggcgccgggccgcgagacaccggaacgcgggggtgcgggagggccggaaagcgcaacgcaaccgggacgatgatgaaacagagatggggggcaccgaccgtgtgggagagggggcggggcagggctcagcagcacgcacggggaggtctgtcgtgcgcaggagccccaggtgagaatcagtcccccggagctcgggtctgggttttattgggacctgccctcggaatcgcggctcccagtccaagcccccctggggggggcggggacagggggtgtgtgtgggtaaaagcaacgtcggaaaatcaaacccaatgccccaaacaggaaaaaaaaagacgggcgggtggagggaaagctggggaagaagaagccaattttacagagacaggccctttagcggggaggcgtcgtagatgagatactgcgtaaagtgggtctctcgcgcgtgggcctccccatcgcgggcgctgcgtagcagggcggggtcgctggcgcaggtgatcgggtaggcttcctgaaacaggccgcacgggtcttccacgagctcgcggcaccccggcgggcgcttaaactgcacgtcgctggcagcggtggccgtggataccgccgatcccgtttccacgataagacgctccaggcagcgatgtttggccgtgatgtcggccgcggtgaagaacttgaagcaggggctgaggacgggcgaggccccgttgaggtgataggccccgttgtacagcaggtccccgtacgagaaccgctgcgacgcccacgggttggccgtggccgcgaagggccgcgccgggtcgctctggccgtggtcgtacatgagggctatgacgtccccctccttgtcccccgcgtacacgccgccggccgcgcgtccccgcgggttgcagggccggcgaaagtagttgatgtccgtggccacgggggtggcgatgaactcacacacggcatcctgcccgtggtccatgccggcgcgccgcggcacctgggcgcagccaaagaccgggaggggctgggccggccccagccggtttcccgccacgaccgcgttgcgcaggtacacggcggccgcgttgtctagcagcgggggggccccgcggccgaggtaaaagttttgggggaggttgcccatgtccgtaacggggttgcggacggtggccgtggccgcgacggcggtgtagcccacacccaggtccacgtttccgcgcggctgggtgagcgtgaagttgacccccccgcccgtttcgtggcgggccacctggagctggcccagaaagtacgcctccgacgcgcgctcggaaaacagcacgttctcggtcacgaagcggtcctgccgcacgacggtgaacccgaacccggggtggaggcccgtcttgagctggtgatacagggccacggggctcatcttgaagtaccccgccatgagcgcgtaggtcagcgcgttctcccccgccgcgctctcgcgggcgtgctgcaccacgggctggcggatggaggagaagtagttggcccccagggccggggggaccagggggacgtggcgcgccaggtcgcgcagggccggggggaagttgggcgcgttggccacgtggtcggcgcccgcaaacagcgcgtggacgggcaggacgtagaagtattcgccattttggatggtgtggtccaggtgctggggggccatgagcagcacgccggcgtgcagcgccccgtcgaagatgcgcatgttggccgtcgacgcggtgttggcgcccgcgtcgggcgccgcggagcacagcagcgccgtcgtgcgctcggccatgttgtgcgccagcacctgcagcgtgagcatggcgggcccgtcgacgacgacgcgcccgttgtggaacatggcgttgaccgtgttggccaccagattggcgggatgcagcgggtgggcggggtcggtcacgggatcgctcgggcactcctcaccgggggcgatctccgggaccaccatgttctgcagcgtggcgtacacgcggtcgaagcggacccccgcggtgcagcagcgcccccgcgagaaggccggcaccagcacgtaatagtagattttgtggtggacggtccagtcggccggccggtgcggccggtcgtcggcggcgtcggccgcgcgggcctgggtgttgtgcagcagccggccgtcgttgcggttaaagtcggccgtcgccacgttgcacgccgccgcgtagacgggctcgtgcccccccgcgtcaatccggcagtctcggtggcggtccagggccgcgtgtcgcataaggccgtcgcagtcccacacgaggggcggcagcagcgccgggtcgcgcatcaggtgattcagctcggcctgagcctgcccgcccagctccgggcccggcagggtaaagtcgtccaccagctgggccagggcctcgacgtgggccaccaggtcccgatacacggccatgcactcctcggggaggtcgcccccgaggtaggtcacgatgtacgagaccagcgagtagtcgttcacgaacgccgcgcatcgcgtgttgttccagtagctggtgatgcactgagtcacgagccgcgccagggcgcagaacacgtgctcgctgccgtgaatcgcggcttgcagcaggtaaaacaccgccgggtagctgcggtcctcgaacgccccgcggacggcggctatggtagccggcgccatggcgtggcggccaacgccgagctccaggccccgggcgtcacgaaacgccaccggacacagcgccaggggcaggttgccgttgaccacgcgccaggtggcctggatcgcccccggaccggccggggggacttcgccgccgggaagctcgacgtcggccacgcccgcgaagaagtcgaacgcggggtgcagctccagagccaggttggcgttgtcgggctgcatgaactgctccgcggtcatctggcactcggcgacccaccggacccggccgtgggcgaggcgctgccgccaggcgttcagaaaacgctgctgcatgtccgcgccggggccggccggggccgcgacgtacgccccgtacggattcgcggcctcgacggggtcgtggttcacgcccccgacggccgcgtcgatgttcatgagcgaaggatgacacacggtcccgaccgcgttctccatggacagccgcagaacctggtggtcctttccccaaaaaaacagctgccggggagggaacgcgcggggctccgggtggccgggggcgggcaccaggtccccggcgtgcgcggcgaagcgctccatggccgggttgaacagccccaggggcaggacgaacgtcaggtccatggcgcccaccagggggtagggcacgttggtggcggcgtagatgcgcttctccagggcctccaggaagaccagcctgtcgcctatggccaccagatccgcgcgcacgcgcgttgtctggggggcgctttcgagttcatccagcgtctcccggttcgcctcgagttgctcctcctgcatatccagcaggtggcggcccacgtcgtccaggctccgcacggccttgcccatcaccagcgccgtgacgaggttggccccgttcaagaccatctcgccgtaggtcaccggcacgtcggcctcggtgtcctccaccttcaggaaggactgcaggaggcgctgtttgatggcggcggtggtgaccagcaccccgtcgaccggccgcccgcgcgtgtcggcgtgcgtcaggcggggcacggccacggacggctgcgtcgccgtggtcaggtccacgagccaggcctcgatggcctcgcggcgatggcccgccttgcccaggaagaagctcgtgtcgcaaaagctccgcttcagctcggcgaccagggtcgcccgggcaaccctggtcgccaggcgcccgttgtcgagatatcgttgcatgggcaacagcagggccaggggaggcgccttctccaacagcacgtgcagcatctggtcggccgtgccgcgctcaaacgcccccaggacggcctggacgttgcgcgcgagctgctggatggcgcgcagctggcgatgcaggctaatgcccgtcccgtccagggcctcccccgtgagcagggcaatggcctcggtggccaggctgaaggcggcgttcagggcccggcggtcgatgaccttcgtcatgtaattatgcacgggctgctcgacggggtgcgggccgtcgcgggcgatgaggggctggtggacctcgaactgcacacgcccttcgttcatgtaagccagctccgggaacttggtgcacacgcacgccacggacaggccgagctccagaaagcgcacgagcgacagggtgttgcagtaggaccccagcagggcgtcaaactctacgtcatacaggctgttttcgtcggagcgcacgcgggcgaaaaaatcaaagagtctgcggtgggacgccacctcgatcgtactcaggatggagccggtgggcaccatggccgcggcgtaccggtaacccggggggtcgcgggcaggagcggccattgggttccttgggggattcgcaggctccatcaagccgagctcgggaaggccaagcccctcccgcacaacgcctcaccgccggcggacgcgactaacaacccacgggccgccaaaaccccaaggggcaacccgaccaacaacaggcgaggggaggaaaggcgtaaagggggcgttgggaggcaaaaagaaagaaaacacccagacgtaggcccgaggaccggccggcgtcctctgtccccgagcacccactgtgcccaacaggcacgggggcgagctgcccctgccttatatacccccccgccacacccccgttagaacgcgacgggtgccttcaagatggccctggtccaaaagcgtgctagaaaaaagttggtaaaggcggcaaagcagtccgccgccgccacccacatggcggcgccggccgcgcaggcgattcccagagaacgggcgcggaggggatccgtgcggggcagcagctggctggcggtgatccaatggaaaagcccgtcgggactgaacgtctcatgggcggccgccaccagggcgcacagggccgcgccgcccatgatcacgcacaacccccaaaacacgggtggcgacaacggcaggcgatcccgtttgatgttcacgtacaggaggagcgcccgtgccagccacgtgacatagtaggcgaggacggcggctataatacatgccggcgccaccgcccgtccggtccacccgtaatacatgcccgcggccaccagctccagcggcttgaggaccaggaacgaccaagcaaacatcaccacccgcttggaaaagaccggctgggtgtggggcggaagacgcgagtaggccgaactgacaaaaaaatcagacgtgccgtacgaggacagcgaaaactgttcatcgagcggcagttctccgtcctccccgccacacgcggcctcgtctaccagctcgcgatccaacaaaggaacatcatcccgcattgtcatggtcggtgcggggagccggcgaggcagcaaaaccgaaagtagtgctggcggcgcgggcccgggtccggacccaagcttcagggatggggggcggaggccaaaatcaaacaagcaccgcgcgggttctacacacaacccccacccgggtagtatccgcggatgcgagtgcctggcgaagtcacgtcccagcaggatataaacctcggccgttgggcccggaacccccgaaattcacacccacgccctgacgcccaaatcatgggtggatgtggttcgcgagccgcacatccgtgcgtccgccctcccccgcgggctgatgacgtggcggttagtcagtgggaaggcagggggaaagatgggttgggggaggaaacgaagaaaacacccagagggccacgtcgggaatgcgcccggagttgtccttaaaaggccggccgtgcgtgacggaagccgtcgtttgcccaagcaccgacgccgcgatccacagtggggggagttcctccgtccggccacaaccctacgcgcgggcggcacgcgcgagagcaacccacgggtcccgttcgcgccaccgccagcccttgctcccaccaccctcctcccaccaccccactattcccccccccaagtccgccccgtggctcgccggccatggagctcagctatgccaccaccctgcaccaccgggacgttgtgttttacgtcacggcagacagaaaccgcgcctactttgtgtgcggggggtccgtttattccgtagggcggcctcgggattctcagccgggggaaattgccaagtttggcctggtggtccgggggacaggccccaaagaccgcatggtcgccaactacgtacgaagcgagctccgccagcgcggcctgcgggacgtgcggcccgtgggggaggacgaggtgttcctggacagcgtgtgtctgctaaacccgaacgtgagctccgagcgagacgtgattaataccaacgacgttgaagtgctggacgaatgcctggccgaatactgcacctcgctgcgaaccagcccgggggtgctggtgaccggggtgcgcgtgcgcgcgcgagacagggtcatcgagctatttgagcacccggcgatcgtcaacatttcctcgcgcttcgcgtacaccccctccccctacgtattcgccctggcccaggcgcacctcccccggctcccgagctcgctggagcccctggtgagcggcctgtttgacggcattcccgccccgcgccagcccctggacgcccgcgaccggcgcacggatgtcgtgatcacgggcacccgcgcccccagaccgatggccgggaccggggccgggggcgcgggggccaagcgggccaccgtcagcgagttcgtgcaagtgaagcacatcgaccgtgttgtgtccccgagcgtctcttccgcccccccgccgagcgcccccgacgcgagtctgccgcccccggggctccaggaggccgccccgccgggccccccgctcagggagctgtggtgggtgttctacgccggcgaccgggcgctggaggagccccacgccgagtcgggattgacgcgcgaggaggtccgcgccgtgcatgggttccgggagcaggcgtggaagctgtttgggtcggtgggggctccgcgggcgtttctcggggccgcgctggccctgagcccgacccaaaagctcgccgtctactactatctcatccaccgggagcggcgcatgtcccccttccccgcgctcgtgcggctcgtcggtcggtacatccagcgccacggcctgtacgttcccgcgcccgacgaaccgacgttggccgatgccatgaacgggctgttccgcgacgcgctggcggccgggaccgtggccgagcagctcctcatgttcgacctcctcccgcccaaggacgtgccggtggggagcgacgcgcgggccgacagcgccgccctgctgcgctttgtggactcgcaacgcctgaccccgggggggtccgtctcgcccgagcacgtcatgtacctcggcgcgttcctgggcgtgttgtacgccggccacggacgcctggccgcggccacgcataccgcgcgcctgacgggcgtgacgtccctggtcctgaccgtgggggacgtcgaccggatgtccgcgtttgaccgcgggccggcgggggcggctggccgcacgcgaaccgccgggtacctggacgcgctgcttaccgtttgcctggctcgcgcccagcacggccagtctgtgtgagatatcccaataaagtgcagtcgttttctaacccacggatgccgttgtatgcctatacgggggactatggggggggaaaggaaaggaaacaggaatggagaagggaaaggaacagaggcggtagcggacgcacggcggacacaataacaaacagaccgcggacacggagggagtcggttgggttgggcgtggacgccgctgcgtccacacacccgtttattcgcgtctccacaaaaatgggacgcacgttcggaccaccctaaggatgcccgccagggccgcggtaatcataacgacccccagcgcggacgcggccagaaacccgggggcgatggtggcgatgggcagcgtgtcaaaggccagcagatgaatcacagttccgttggggaacaacaacagggccacggacggcacgtcgctggaaaacacgttcggggtgcccgccaccggcccctgggccagctgctgttgggtggcatccgtgtccaccagcagcaccgacatgacctccccggccggggtgtagcgcagaaacacggcccccacgaggccgaggtcgcgccggttttcggtgcgcaccagccgcttcggctcaatctcccgcgcgtgcccttcgcaggtggcggtgagataggtgataaacagcgggcggcggacgtcaacgcccgtaagcttgtatccgatcccgcggggcaagggggtgtgggtgacgacgtagctggcgttgtgggtgatgggcacgaggatccggggctccgcgttgtgcgacgggccgctacactggtgggtggcctccgggacgaaggcgcggatcagggcgttgtagtgcgcccagcgcgtgagaacggaggccacgccgcgggtctgttgtgccatgacgtccgccgggatgtcggatcgggtggccatggccagcgcgtccaggatgaacccgccctcggcgagatcgaagcgcagggaagctgcgcatggggaaaagtggtccgggagccagaagaggtttttctggtggtcggtcctggctagcgcggcccggagatcggcgtgggtcgccgcggcgacgtcggacgtacacagggccgtggttatgaggaggccccggcgggcgcgttcccgctgctcggccgagggcgcgcccgccaggaacggcgcccggaggacggccgtggcgtaaaacagcgctcggcggaccatcggggcggttagcgcgcggccgccgagaaactcggcgtacagggcgtcgatcaggcgggccgcgctcggggccaccgcgccataggccgcggggctgtccaacacgaacgccagctgatagcccagcgcgtgcgccgccaggctctgctctcgctcgaggatcgcggccaccagatgcccgaggcgcgcctccagccgcaggcgggccgccgggtccaacacggacacgttcaggaacaccgagtcggccgcgcagcccgctgctccccgggcggccaggccggccagcacgcgcgagtgggccaaaaagcccagcaggtcggagaggcgaatcgcgtcgtgggcgtgggccgcgttgacgaacgcaaaccccgacgaggcgagcagccccgcgaggcgccagaacagggacggacgcgcgtccgtgccggagcccgggtcctcccccaaaaactccgcataggcccgcgacatatactgggcgtagttcgtgctctcctcggggtagccggccacccgccggagggcgtccagcgccgagccgttgtcggcgggcgtcggggcccccaggacaaagacgcgatacctggggccggccggaggcccggggagcaccgcgggggcgttttcgtcggtcggatttccgacccgagcgagggtcttgtccgcaggcaccactatgatctcggccggagggctgtcccgcatcgatatcacgagccccatgaagcccttcccgtatcgcgcgcgcacgagcgcggcgtcgcacccgaacgccagcccgcccgtcgtccagacgcccacgggccacgtcgaggccgacggggagaggtacacgtaccgacccggagtccgtagcaggcccctggcggccagccaggtcacggatgcgttgtgcagatgcgcgatgctcaggttcgtcgtcggatgcctcggtgtccccgcgggcggccccgggggcggcgcgttgcgtcggccgtccgggtgcctctcggtcgccccgtcgtctccccgcgggaacgtaagcccctcgcggtccggcgcggccgcgaatgttacccaggcccgggaccgcaacagcgcggaggcgccggggttgtgcgacagtcccttgagctgggtcacctcggcggggggacgggacgtgggccccgcctcggggagctcgggcaggctcgcgttccgaggccggccgagcagataggtctttgggatgtaaagcagctgcccggggtcccgaggaaactcggccgtggtgaccaacacgaaacaaaagcgctcggcgtaccaccgaagcatgggcacggatgccgtagtcaggttgagttcgcccgggggcgccaagcgtccgcgctgggggtcgctggcgtcgggggtgttgggcaaccacagacgcccggtgtttgtgtcgcgccagtacgtgcgggccaaccccagaccgtgcaaaaaccacgggtcgatttgctccgtccagtacgtgtcatggcccccggcaacgcccaccaggacccccatcaccacccacagaccggggcccatggtcgtccgtcccggctgccagtccgcagatgggggggggtgtccgtacccacggcccaaagaggctccgcacctcggaggctatcggaggccctttgttgccgtaagcgcgggccaaaggatggggtggggtgagggtaaaagcacaaagggagtaccagaccgaaaacaaggacggatcggcccgctccgtttttcggtggggtgctgatacggtgccagccctggccccgaacccccgcgcttatggacacaccacacgacaacaatgccttttattctgttcttttattgccgtcatcgccgggaggccttccgttcgggcttccgtgtttgaactaaactccccccacctcgcgggcaaacgtgcgcgccaggtcgcgtatctcggcgatggacccggcggttgtgacgcgggttgggatcatcccggcggtgaggcgcaacagggcgtctcgacacccgacgggcgactgatcgtaatccaggacaaatagatgcatcggaaggaggcggtcggccaagacgtccaagacccaggcaaaaatgtggtacaagtccccgttgggggccagcagctcgggaacgcggaacagggcaaacagcgtgtcctcgatgcggggcagagaccccgcgccgtcctcggggtcggggcgcggggtcgccgcggcgacccccgtcagccggccccagtcctcccgccacctcccgccgcgctgcaggtaccgcaccgtgttggcgagtagatcgtagacacggcgaatggcggacagcatggccaggtcaagccgctcgcccgggcgttggcgtctggccaggcggtcggcgtgttcggcctccggaaggacacccaggaccaggttcgtgccgggcgcggtcgggggcatgagggccacgaacgccaacacggcctggggggtcatgcttcccatgaggtaccgcgcggccgggtagcacagcagggaggcgatagggtgccggtcgaaaacaagggtgagggccgggggcggggcttgcgggcccacagcctcccccccgatatgaggagccaaaacggcgtccgtcgccgcataaggcgtgctcattgttatctgggcgctggtcattaccaccgccgcctccccggccgatatctcgccgcggtccagacggtgctgcgtgttgtagatgttcgtcagggtctcggaggcccccagcacctgccagtaagtcatcggctcggggacgtagacgatattgtcgcgcggccccagggcctccatcagctgcgcggaggtggtggtcttccccaccccgtggggtccgtctatataaacccgcagcagcgtgggcagctccggatccccgcgggctccggaggccccctggcgatggctaggacgggacgccgcgcggccgtcggtaggcccgctcgcacgagcagcctgaccgaacgcaggcgcgtgctgttggccggcgtgagaagccatacccgcttctacaaggcgttcgcccgagaggtgcgggagttcaacgccaccaggatttgtggaacgctgctgacgctgatgagcgggtcgctgcagggtcgctcgctgttcgaggccacgcgcgtcaccttaatatgcgaagtggacctcgggccgcgccgcccagactgcatctgcgtgttcgaattcgccaatgacaaaacgttgggaggtgtgtgcgtcatcctggagctaaagacatgcaaatcgatttcttccggggacacggccagcaaacgcgaacagcggaccacgggcatgaagcagctgcgccactccctgaagctgctgcagtcgctcgcgcctccgggggacaaggtcgtctacctgtgtcctattttggtgtttgtcgcgcagcgtacgctgcgcgtcagccgcgtgacccggctcgtcccgcaaaagatctccggcaacatcaccgcggccgtgcggatgctccaaagcctgtccacgtatgccgtgccgccggaaccgcagacccggcggtcgcggcgccgggtcgccgcgaccgccagaccgcaaaggcccccctccccgacacgtgacccggaaggcacggcgggtcatccggccccaccagagagcgaccccccctccccaggggtcgtaggcgtcgctgcggagggtgggggtgtgcttcagaaaatcgcggcgcttttttgcgtgccggtggccgccaagagcagaccccggaccaaaaccgagtgaggttctgtgtgttgtttttttttttttttcctcgttttgttttctcttctttcccccccccctcccccgcttctggccaagcatcctcacctgcttaagcggaacccgcgggcgcgcggggactcatttgtcgccggcgacacccacccgacaacagcccctgggtgtcgaccgctgtcgcccccgtctgtcgcctctcccttttttccccccctcaaagaacgtggtgttgggcgccggccaattcttcccggagcgccgtcgtcgcccgcccgccgccctcgaacatggacccgtactaccctttcgacgcgctggacgtttgggaacacaggcgcttcatcgtcgccgactccaggagcttcatcacccccgagttcccccgggacttctggatgttgcccgtgttcaacatcccccgggagacggcggcggagcgggcggcagtgctgcaggcccagcgcaccgcggccgcggcggccctggagaacgccgccctccaggccgccgagctgcccgtcgacatcgagcgccggatacgcccgatcgagcagcaggtgcatcacatcgccgacgccctggaggcgctggagaccgcggcggccgcggccgaagaggcggatgccgcgcgggacgccgaggcgaggggggagggcgctgcggacggggcagcgccgtcgcccaccgcgggccccgccgccgcggagatggaggttcagatcgtacgcaacgacccgccgctacgatacgataccaacctccccgtggatctgctacacatggtgtacgcgggccgcggggccgcgggttcgtcgggagtcgtctttggtacctggtaccgcacgatccaggaacgcaccatcgcggacttccccctgaccacccgcagcgccgactttcgagacgggcgcatgtccaagaccttcatgaccgcgctggtcctgtctctgcagtcgtgcggccggctgtacgtgggccagcgccactattccgccttcgagtgcgccgtgctgtgtctgtatctgctgtaccgaaccacccacgagtcctcccccgatcgcgatcgcgctcccgttgcgttcggggacctgctggcccgcctgccgcgctacctggcgcgtctggccgcggtaatcggcgacgagagcggacgcccgcagtaccgctaccgcgacgacaagctgcccaaagcgcagttcgcggcggccggcggccgctacgagcacggggccctggccacccacgtcgtgatcgccacgttggtgcgccacggggtgctaccggcggccccgggcgacgttccccgagacaccagcacccgcgtgaaccccgacgacgtggcccaccgcgacgacgtcaaccgcgccgccgccgcgtttttggcacgcggccacaacctcttcctgtgggaggaccagacgctgctgcgggcgaccgccaacaccattacggccctggccgtgcttcggcggctcctcgcgaacggcaacgtgtacgcggaccgcctcgacaaccgcctgcagctgggcatgctgatcccgggagccgtcccggcggaggccatcgctcggggggcgtccggattggactcgggcgccataaaaagcggcgacaacaacctggaggcgctgtgcgttaactatgtacttccgctgtatcaggcagaccccacggtcgagctgacccagttgtttccggggctggccgccctgtgcctggacgcccaggcggggcggccactggcgtcgacgaggcgcgtggtggatatgtcgtcgggcgcccgccaggcggcgctcgtgcgcctcaccgcgctggagctcatcaaccgcacccgcacaaacaccacccctgtgggggagattattaacgcccacgatgccttggggatacaatacgaacagggcctggggctgctcgcccagcaggcacgcatcggcttggcgtcaaacaccaagcgattcgccacgttcaacgtgggcagcgactacgacctgttgtactttttgtgtctcgggttcattccccagtacctgtccgtggcctagggaagggtgggggtggtggtggtggggtgtttttctgttgttgtttctggtccgcctggtcacaaaaggcacggcgccccgaaacgcgggctttagtcccggcccggacgtcggcggacacgcaacaacggcgggccccgtgggtgggtaagttggttcgggggcatcgctgtattcccttgcccgcttccacccccccccccttcccgttttgtttgtttgtgcgggtgcccatggcgtcggcggaaatgcgcgagcggttggaggcgcctctgcccgaccgggcggtgcccatctacgtggccgggtttttggccctgtacgacagcggggacccgggcgagctggccctggacccagacacggtgcgtgcggccctgcctccggagaaccccctgccgatcaacgtagaccaccgcgctcggtgcgaggtgggccgggtgctcgccgtggtcaacgaccctcgggggccgttttttgtggggctgatcgcgtgcgtgcagctggagcgcgtcctcgagacggccgccagcgccgctatttttgagcgccgcggacccgcgctctcccgggaggagcgtctgctgtacctgatcaccaactacctgccatcggtctcgctgtccacaaaacgccggggggacgaggttccgcccgaccgcaccctgtttgcgcacgtggccctgtgcgccatcgggcggcgccttggaaccatcgtcacctacgacaccagcctagacgcggccatcgctccgtttcgccacctggacccggcgacgcgcgagggggtgcgacgcgaggccgccgaggccgagctcgcgctggccgggcgcacctgggcccccggcgtggaggcgctcacacacacgctgctctccaccgccgtcaacaacatgatgctgcgtgaccgctggagccttgtggccgagcggcggcggcaggccgggatcgccggacacacgtaccttcaggcgagcgaaaaatttaaaatatggggggcggagtctgcccctgcgccggagcgcgggtataaaaccggcgccccgggtgccatggacacatcccccgccgcgagcgttcccgcgccgcaggtcgccgtccgtgcgcgtcaagtcgcgtcgtcgtcttcttcttcttcttttccggcaccggccgatatgaaccccgtttcggcatcgggcgccccggcccctccgccgcccggcgacgggagttatttgtggatccccgcctctcattacaatcagctcgtcaccgggcaatccgcgccccgccacccgccgctgaccgcgtgcggcctgccggccgcggggacggtggcctacggacaccccggcgccggcccgtccccgcactacccgcctcctcccgcccacccgtacccgggtatgctgttcgcgggccccagtcccctggaggcccagatcgccgcgctggtgggggccatcgccgccgaccgccaggcgggtgggcttccggcggccgccggagaccacgggatccgggggtcggcgaagcgccgccgacacgaggtggagcagccggagtacgactgcggccgtgacgagccggaccgggacttcccgtattacccgggcgaggcccgccccgagccgcgcccggtcgactcccggcgcgccgcgcgccaggcttccgggccccacgaaaccatcacggcgctggtgggggcggtgacgtccctgcagcaggaactggcgcacatgcgcgcgcgtacccacgccccctacgggccgtatccgccggtggggccctaccaccacccccacgcagacacggagacccccgcccaaccaccccgctaccccgccaaggccgtctatctgccgccgccgcacatcgcccccccggggcctcctctatccggggcggtccccccaccctcgtatcccccagttgcggttacccccggtcccgctcccccgctacatcagccctcccccgcacacgcccacccccctccgccgccgccgggacccacgcctccccccgccgcgagcttaccccaacccgaggcgcccggcgcggaggccggcgccttagttaacgccagcagcgcggcccacgtgaacgtggacacggcccgggccgccgatctgtttgtgtcacagatgatggggtcccgctaactcgcctccaggatccggacttggggggggtgtgtgttttcatatattttaaataaacaaacaaccggacaaaagtatacccacttcgtgtgcttgtgtttttgtttgagaggggggggtggagtgggggggaaagtgggccgaatgacacaaaaattaggtcggaggggtgaggggggggggctaggagccgaaccgatggcccccacacgcgacggaaggcccggaagactaccacggggagggggtgtggaaagcgaccggtcgcagggagacggggttggtttggggttggtttggggttggttttcccgttagcacatgtctgcatttgtttttctagtcacacgccccccccccccaaataaaaaccaaggcaaaacaataccagaagtcatgtgtatttttgaacatcggtgtctttttatttatacacaagcccagctcccctcccctcccttagagctcgtcttcgtctccggcctcgtcctcgttgtggagcggagagtacctggctttgttgcgcttgcgcagaaccatgttggtgaccttggagctgagcagggcgctcgtgcccttctttctggccttgtgttccgtgcgctccatggccgacaccaaagccatatatcggatcatttctcgggcctcggccaacttggcctcgtcaaacccgcccccctccgcgccttcctccccctccccgcccacgcccccggggtcggaagtcttgagttccttggtggtgagcggatacagggccttcatgggattgcgttgcagttgcaggacgtagcggaaggcgaagaaggccgcgaccaggccggccaggaccagcagccccacggcaagcgccccgaaggggttggacataaaggaggacacgcccgagacggccgacaccacgccccccactactcccatgactaccttgccgaccgcgcgccccaagtcccccatcccctcgaagaacgcgcacagccccgcgaacatggcggcgttggcgtcggcgcggatgaccgtgtcgatgtcggcaaagcgcaggtcgtgcagctggttgcggcgctggacctccgtgtagtccagcaggccgctgtccttgatctcgtggcgcgtgtagacctccaggggcacaaactcgtggtcctccagcatggtgatgttcaggtcgatgaaggtgctgacggtggtgacgtcggcgcgactcagctggtgagagtacgcgtactcctcgaagtacacgtagcccccgccgaagatgaagtagcgccggtggcccacggtgcacggctcgagcgcgtcgcgggtgaggcgcagctcgttgttctcgcccagctgcccctcgatcagcgggccctggtcttcgtaccgaaagctgaccagggggcggctgtagcacgtccccggccgcgagctgacgcgcatcgagttctgcacgatcacgttgtccggggcgacgggcacgcacgtggagacggccatgacgtctccgagcatgcgcgcgctcacccgccggccgacggtggcggaggcgatggcgttggggttgagcttgcgggcctcgttccagagagtcagctcgtggttctgcagctcgcaccacgcgacggcgatgcgccccagcatgtcgttcacgtggcgctgtatgtggttatacgtaaactgcagccgggcgaactcgatcgaggaggtggtcttgatgcgctccacggacgcgttggcgctgggcgcctcccgcagtggcgcgggcgtggcattccggggcttgcggtcctgctcccgcatgtactcccgcacgtacagctcggcgagcgtgttgctgaggaggggctggtacgcgatgaggaagccccccgtggccaggtagtactgcggctggcccaccttgatgtgcgtggcgttgtacttgcgcgcaaacatgcggtcgatggcctcgcgggcatcccggccgatgcagtcgcccaggtcgacgcgcgagagcgagtactcggtcaggttggtggtgaaggtggtcgagatggcgtcggaggagaagcggaaggagccgccgtactcggcgcggagcatctcgtccacctcctgccacttggtcatggtgcagaccgccggtcgcttcggcacccagtcccaggccacggtaaacttgggggtcgtcagcaagttgcgggtcgtcggcgacgtggcccgggccttcgtggtgaggtcgcgcgcgtagaagccgtcgacctgcttgaagcggtcggcggcgtagctggtgtgctcggtgtgcgacccctcccggtagccgtaaaacggggacatgtacacaaagtcgcccgtcgccagcacaaactcatcgtacgggtacaccgaccgcgcgtccacctcctcgacgatgcagttgaccgtcgtgccgtaccgatggaacgcctccacccgcgaggggttgtacttgaggtcggtggtgtgccacccccggctcgtgcgcgtggcgaccttcgccggcttgagctccatgtcggtctcgtggtcgtcccggtgaaacgcggtggtctccatgttgttccgcacgtacttggccgtggagcggcagacccccttggcgttaatcttgtcgatcacctcctcgaagggaacgggggcgcggtcctcgaatatccccataaactgggagtagcggtggccgaaccacacctgcgacacggtcacgtctttgtagtacatggtggccttgaatttgtacggggcgatgttctccttgaagaccaccgcgatgccctccgtgtagttctgcccctccgggcgcgtcgggcagcggcgcggctgctcaaactgcaccaccgtggcgcccgtcgggggcgggcacacgtaaaactgggcatcggcgttctcgaccttgatttcccgcaggtgcgcgcgcagcgtggcgtggccggcggcgacggtcgcgttggcgtcggggggcggggtcgcctcgggccgcttgggcggctttttggttttccgcttccgggccttggtggtcgcggggctcgggacggggggcggccgggaggcgggacccccgttcgccgcgacggtcgcggccacgccgcccgaggcgcggggggccgccggggccgccggggccgccgacgccaccgcggccaccagcgcccccacgaccagcgcgcaaatcaagccccccccgcgcatggcgggcctacgggggcgcgtcgctcccgccgcccgctagtctgggggcgaggtgctgcaggaccgagtagaggatggaaaaaacgtctcggtcgtaaaccacgaccgagcggggtccgatgcagccgtcggggccgctctcgacgatggccaccagcggacagtcggagttgtacgtgaggtacacgcccggcgggtagcggtacagaccttcggaggtcgggcggctgcagtcggggcggcgcaactcaagctccccgcaccggtagaccgacgcaaagagtgtggtggcgataatgagctcgcgaatatatcgccaggcggcgcgctgggtgggcgtgattccggaaacaccgtcaaaacagtagaacttttgaaactcgctgacggcccaatcagcgcccgaaccccccgcgcccatgatgaagcgggcgagttcctccttgaggtgcggcaggagccccacgttctcgacgctgtagtacagcgcggtgttggggggctgggcgaagctgtgggtggagtggtcgaacaggggcccgttgacgagctcgaagaagcgatgggtgatgctggggagcagggccgggtccacctggtggcgcagcagcgacgctcgcatgaaccggtgcgcgtcaaacacgcccggggcggcgcggttgtcgatgaccgtgcccgcgcccgccgtcagggcgcagaagcgcgcgcgcgccgcgaagccgttggcgaccgcggcgaaggtcgcgggcagcacctcgccgtggacgctgacccgcagcatcttctcgagctccccgcgctgctcgcgcacgcagcgcccgaggctggccagcgaccgcttggtcaggcggtccgcgtacagccgccggcgctcccgcacgtccgcggcggcccgcgtcgcgatgtcgccccagctctccggcccctgcgcccctggctcggggccgcgctccccgtcctcgctcgcgggcgtccccgcgccacgcctccgccccccctcctccgcggcggcccggggctcttcctcctcggcccccccggtcgcgccgccggcccccagccgcgccagcacgcggcgcagcgcctcctcgtcgcactgctcggggctgacgagccgccgcagcagcggcgtcgtcaggtggtggtcgtagcacgcgcgtatcagcgcctcgatctgatcgtcgggcgacgtcgcctggccgccgatgatcagggcgtccaccatgtccagcgccgccaggtggcccccgaacgcgcgatcgaagtgctccgcccgccgcccgaacagcgccagctccacggccaccgcggcggtctcctgctgcagctcgcgctgcgccagcgcgttcaggttgtcggcgaaggcgtccatggtggagtggcgggcgcgatcgccggacgccagccagaagcgcagctcgctgatggcgtacaggccgggcgtagtggcctgaaacacgtcatgcgcctccagcagggcgtcggcctcctcgcggacagaagagctatcggcgggcggcgggccggcccgggccccgccgcccgccgcggtccgcgccagcgcctggtccagcacacagagcgctcgcgcgcgggcggcgtccgacagcccggcggcgtggggcaggtaccgtcgcagctcgttggcgtccagccgcacctgggcctgttgggtgacgtggttacagatgcggtccgccaggcggcgggcgatggtcgccccctggttcgcggtgacgcacagctcctcgaaacagaccgcgcacgggtgggacgggtcgctcagctccgggggcacgatgaggcccgaccccaccgccgccaccataaactcccggacgcgctccagcgcggccgtggcgccgctcgggggggtgatgaggtggcagtagttcagctgcttgagaaaattctcgacatcatgcaggaagcacagctccatgcggacgtccccgccgtacgtctgcagccggatctgctggtggtacggacagggtcgggccagacccatggtctcggtgaaaaaggcagagacgtcacccgtggtcgcgaacgtttccaggtggcccaggagccgctccccctcgcgccacgcgtactccaggagcaactccagggtgaccgacagcggggtgagaaaggcggcggcctgagcctccagccccggccgcaggtgccgccgcagcacgcgcacctggagcgcgttgagctttagctgggcgagcttccccaggccgatctgggggtcgcatcgtcgaagcagctctagctgaaaaacgtacgtctgtacctgcccgagcagggccaacagtttctgtcgggccgcagtgggctcggaaaccgcggccgggggcgcggccgccatggcgagtcacccggccgtgctgtggtttagttaaggtttgggggggggtgggtcagaggcgcgccccgcgcggactgatgcggcggcgggcccctgacatcccctctttatgcccgtcgcccgcccgcccgccccgccggtgtgccgtgattcgcggagtcggggccttgtgtttctttctttcccccccgaatccgttctttcttcctcacccccccctccccacacacccacccaggactcgccaccacaaggaggcgagagcccgtcgctaacccaaagacacagtcacgagacacgatatcgactgtagttgcgatcgtttattttatacacaacaccaacctttccttcgaccccccccacccccgcccctagagcatatccaacgtcaggtcctttttctccggtggtccctccccaaacggatcgtcgccgtgaaacgcccgctttcgggcgacgccggccgcccccgccgccgccgccaaaccgccgaacgacgccgcgtggtcatcctcgtcgccgaaatccccaaagttaaacacctccccggcggcgccgagctggctgaccagggcctccgcctcgtgggccacctccagggccgcgtcggtcgaccactcgccgtgcccgcgctccagggcgcgggtggtaaactccatcatttcctcgctcaggtactcgtcctccagcagcgccagccagtcctcgatctgcagctgctgggtgcgggggcccaggctcttgacggtcgccacaaacacgctgctggcgaccgccgccccgccctccgcaatgatgccccggagctgctcgcacagcgaatgctcgtgggccccgcccccgagactcgacgccgcgcacacaaacccggccctggggcaggccaggacaaacttgcgggtgcggtcaaagatcagcagcgggcacgcgtttttgccgcccagcaggctggcccagttcccggcctgaaacacgcggtcgttgccggccatgccgtagtatttgctgatgctgaggcccagcacgaccatcgggcgcgcggccatcacgggccgcagcaggttgcagctcgcgaacatggacgtccaggcgccggggtgcgcgtcgagggagtccatcagcgcgcgggccccggcctccaggcccgcgccgccctgcggggcccaggcggccgccgcctgcacgctggggggacggcgggacccggcgatgacggccgtgagggtgtttatgaagtacgtcgagtggtcgcagtacctcaagatctggttggccatgtagtacatggccagttcgctcacgttattgggggccaggttgataaagttaatcgcgccgtagtccagggagaacctcttaatgaacgcgatggtctctatgtcctcgcgcgacaagagccgggcggggagctggttgcgctggagggcggtccagaaccactgcgggttcggctggttcgaccccgggggcttgccgttgggaaagatgaccgcgtggaactgcttcagcaggaagcccagcggtccgaggaggatgtccacgcgcttgtcgggcttctggtaggcgctctggaggctggcgacccgcgccttggcggcctcggacgcgttggcgctcgcgcccgcgaacaacacgcggctcttgacgcgcagttccttgggaaacccaagggtcacgcgggcaacgtcgccctcgaagctgctctcggcgggggccgtctggccggccgttaggctgggggcgcagatagccgccccctccgagagcgcgaccgtcagcgtcttcgccgacaggaacccgttgttgaacaggtccatgacgcgccgccgcagcaccggttggaattgattgcgaaagttgcgcccctcgaccgactgcccggcgaacaccccgtggcactggctcagggccaggtcctggtacacggcgaggttggaccgccgcgcgaggagctgcagcagggggcacggcccgcaggtgtacgggtccagcgacagcgacatggcgtggttggcctcggccagaccgtcgcggaacttaaagttgcgcccctcgatcaggttgcgcatcagctgttccacctcgcgatccaccagctgcttgatgttgttcaccaccgtgtgcagggcctcgcggttgccgataatcgtctccagcctccccagggccgtgggcaccgcctggtccacgtactgcagggcctcgagctcggccatgacgcgctcggtggccgcgcggtacgtctcctgcatgatggtccgggtgttctcggacccgtccgcgcgcttcagggccgagaaggcggcgtagttccccagcacgtcgcagtcgctgtacgcgctgttcatcgttccgaagaccccaatggccccccgggcggcgctcgcgaacttggggtggcgggcccgcagccgcatcagcgtcgtgtgcgcgcaggcgtggcgggtctcgaaggtacacaggttgcagggcacgtcggtctggcccgagtccgcgacgtagcgaaacacgtccatctcctggcgcccgacgatgactccgccgtcgcagcgctccaggtaaaacagcatcttggccagcagggccggagagaacccgcacagcatggccaggtgctcgccggcgaactcctgggttccgccgacgaggggcgccgtggggcgcccctcgtacccgggcaccacgtggccctcgcggtccagctgcgggttggccgccacgtgcgtgccgggcacgagaaagaagcggtaaaaggagggcttgctgtggtccttggggtccgccggcccggcgtcgtccacctcggtcaggtggagggccgaattggtgctgaacaccatggcgcccacgaggcccgcggcgcgcgccaggtacgccccgacggcgccggcgcgggccgcgggcgtttcctggccctcaagcaggggccacgtggtgatgtcggggggcggctcgtcaaagaccgccatcgacacgatggactccagggccagggcggcgtcgcccgccatcaccgaggccaggcgctgctcaaacccgcccgccgggcccttgttcccggcgtcgcgcgcgccccgctggggcttaccctggctggcctcgaaggccgtgaacgtaatgtcggcggggagggccgcgccctcgtggttttcgtcgaacgccaggtgggcggccgcgcgggccacggcgtccacgttccgggcacgcagggccacggcggcgggcccgacgaccgcctcgaacagcaggcgggcgagggggcggttgaaaaacggaagggggtagttgaaattctccccgatcgatcggtggttgcagttaaacggatcggcgatgacccggctaaaatccggcataaacatctgcagcggatacacggggatgcggtgaacctccgcgtccccgatggttaccttgtccatcccgcccagatgcaggaaggtgttgctgatgcacacggcctcccggaagccctccgtgatcaccagatacagcaaggcccggtccgggtccagtccgagccgctcgcacagcgcgtcccccgtcgtctcgtgctttaggtcgcagggccggggcgcgtagtccgcgaagccaaaatggcggcgcgcccgctcgcagagccgcgtcaggttgggggcctgggtgctgggggccaggtggcggccgccgtgaaagacgtaaacggacgggctgtagtgcgagggcataagcttgagggacaccgcggtccccccaaggcccgtcgtgcgggacccgacgaccgcggccacgttggcctcaaacccgctctccacggtcaggccgacgatgaggggcgcgacggcgacgtccgcgtcgccgctgcgcgccgacagtagcgacagcagctccaggccttcggccggacaggcgcggccatacacgtaccccatcggccccggaggaaccttgacggtggtcgtcgttttgggcttggtgtccatggctttcgggagatcggcgaccggcaggaacgggggcccggcaagacgaccgggggcagacgggggaggccgcgcgtggtcgacggctgctgcccgccgtcgtctctccgatggggtcgaatgccggcgctgggggtggggtctacacccgcccgttcgccgagcggcccctggtgggggtgggatgggtgggatggggtgggcgagaatggcccgccaccggatcgcgccggacgggggggcccggggttgggcaaggtttgggcgcaaggctccagcggcgattcgagaggcctgcggatggcggcccagagctgggtatgctcggccggggcggccggtatatgtacggcgtgctgggaggggcggcgtcgggccccgcccacggtccgccacgccccgcgcgtcatcggcagggggcgtggccgcccttctaaaaaaagtgagaacgcgaagcgttcgcactttgtcctaataatatatatactattaggacaaagtgcgaacgcttcgcgttctcactttttttagaagggcggccacgccccctttgacgtcacgctcacccgggcggccggccgcccataagcgcggcctgccgggccgataaaaagaaaccgcggcgcccccgcggacaccacacactggctctcgaaccccggacgcgcagaagggacccgggcgcgggtccgccggtaagagccggggggaacatcggcaccgccatcccaccccgagctgttgggtgggcgggtgggggggctggtgaggcggtggtgggagggggcggcgtatagcaggacaacgaccggcggcgatgttttgtgccgcgggcggcccggcttcccccggggggaagccggcggctcgggcggcgtctgggttttttgccccccacaacccccggggagccacccagacggcaccgccgccttgccgccggcagaacttctacaacccccacctcgctcagaccggaacgcagccaaaggccctcgggccggctcagcgccatacgtactacagcgagtgcgacgaatttcgatttatcgccccgcgttcgctggacgaggacgcccccgcggagcagcgcaccggggtccacgacggccgcctccggcgcgcccctaaggtgtactgcgggggggacgagcgcgacgtcctccgcgtgggcccggagggcttctggccgcgtcgcttgcgcctgtggggcggtgcggaccatgcccccgaggggttcgaccccaccgtcaccgtcttccacgtgtacgacatcctggagcacgtggaacacgcgtacagcatgcgcgccgcccagctccacgagcgatttatggacgccatcacgcccgccgggaccgtcatcacgcttctgggtctgacccccgaaggccatcgcgtcgccgttcacgtctacggcacgcggcagtacttttacatgaacaaggcggaggtggatcggcacctgcagtgccgtgccccgcgcgatctctgcgagcgcctggcggcggccctgcgcgagtcgccgggggcgtcgttccgcggcatctccgcggaccacttcgaggcggaggtggtggagcgcgccgacgtgtactattacgaaacgcgcccgaccctgtactaccgcgtcttcgtgcgaagcgggcgcgcgctggcctacctgtgcgacaacttttgccccgcgatcaggaagtacgaggggggcgtcgacgccaccacccggtttatcctggacaacccggggtttgtcaccttcggctggtaccgcctcaagcccggccgcgggaacgcgccggcccaaccgcgccccccgacggcgttcggaacctcgagcgacgtcgagtttaactgcacggcggacaacctggccgtcgagggggccatgtgtgacctgccggcctacaagctcatgtgcttcgatatcgaatgcaaggccgggggggaggacgagctggcctttccggtcgcggaacgcccggaagacctcgtcatccagatctcctgtctgctctacgacctgtccaccaccgccctcgagcacatcctcctgttttcgctcggatcctgcgacctccccgagtcccacctcagcgatctcgcctccaggggcctgccggcccccgtcgtcctggagtttgacagcgaattcgagatgctgctggccttcatgaccttcgtcaagcagtacggccccgagttcgtgaccgggtacaacatcatcaacttcgactggcccttcgtcctgaccaagctgacggagatctacaaggtcccgctcgacgggtacgggcgcatgaacggccggggtgtgttccgcgtgtgggacatcggccagagccactttcagaagcgcagcaagatcaaggtgaacgggatggtgaacatcgacatgtacggcatcatcaccgacaaggtcaaactctccagctacaagctgaacgccgtcgccgaggccgtcttgaaggacaagaagaaggatctgagctaccgcgacatccccgcctactacgcctccgggcccgcgcagcgcggggtgatcggcgagtattgtgtgcaggactcgctgctggtcgggcagctgttcttcaagtttctgccgcacctggagctttccgccgtcgcgcgcctggcgggcatcaacatcacccgcaccatctacgacggccagcagatccgcgtcttcacgtgcctcctgcgccttgcgggccagaagggcttcatcctgccggacacccaggggcggtttcggggcctcgacaaggaggcgcccaagcgcccggccgtgcctcggggggaaggggagcggccgggggacgggaacggggacgaggataaggacgacgacgaggacggggacgaggacggggacgagcgcgaggaggtcgcgcgcgagaccgggggccggcacgttgggtaccagggggcccgggtcctcgaccccacctccgggtttcacgtcgaccccgtggtggtgtttgactttgccagcctgtaccccagcatcatccaggcccacaacctgtgcttcagtacgctctccctgcggcccgaggccgtcgcgcacctggaggcggaccgggactacctggagatcgaggtggggggccgacggctgttcttcgtgaaggcccacgtacgcgagagcctgctgagcatcctgctgcgcgactggctggccatgcgaaagcagatccgctcgcggatcccccagagcacccccgaggaggccgtcctcctcgacaagcaacaggccgccatcaaggtggtgtgcaactcggtgtacgggttcaccggggtgcagcacggtcttctgccctgcctgcacgtggccgccaccgtgacgaccatcggccgcgagatgctcctcgcgacgcgcgcgtacgtgcacgcgcgctgggcggagttcgatcagctgctggccgactttccggaggcggccggcatgcgcgcccccggtccgtactccatgcgcatcatctacggggacacggactccattttcgttttgtgccgcggcctcacggccgcgggcctggtggccatgggcgacaagatggcgagccacatctcgcgcgcgctgttcctccccccgatcaagctcgagtgcgaaaaaacgttcaccaagctgctgctcatcgccaagaaaaagtacatcggcgtcatctgcgggggcaagatgctcatcaagggcgtggatctggtgcgcaaaaacaactgcgcgtttatcaaccgcacctccagggccctggtcgacctgctgttttacgacgataccgtatccggagcggccgccgcgttagccgagcgccccgcagaggagtggctggcgcgacccctgcccgagggactgcaggcgttcggggccgtcctcgtagacgcccatcggcgcatcaccgacccggagagggacatccaggactttgtcctcaccgccgaactgagcagacacccgcgcgcgtacaccaacaagcgcctggcccacctgacggtgtattacaagctcatggcccgccgcgcgcaggtcccgtccatcaaggaccggatcccgtacgtgatcgtggcccagacccgcgaggtagaggagacggtcgcgcggctggccgccctccgcgagctagacgccgccgccccaggggacgagcccgcccccccagcggccctgccctccccggccaagcgcccccgggagacgccgtcgcatgccgaccccccgggaggcgcgtccaagccccgcaagctgctggtgtccgagctggcggaggatcccgggtacgccatcgcccggggcgttccgctcaacacggactattacttctcgcacctgctgggggcggcctgcgtgacgttcaaggccctgtttggaaataacgccaagatcaccgagagtctgttaaagaggtttattcccgagacgtggcaccccccggacgacgtggccgcgcggctcagggccgcggggttcgggccggcgggggccggcgctacggcggaggaaactcgtcgaatgttgcatagagcctttgatactctagcatgagccccccgtcgaagctgatgtcccgcatcttgcaataaatgtctgcggccgacacggtcggaatttccgcgtccgctggtttctctgcgttgcgtctgaccacgagcacaaacgtgctctgccacacgtgggcggcgaaccggtagccggggcacgcggtcagcatccgatcgatgagccggtagtgcaggtgggccgacgtgccggggaagatgacgtacagcatgtggcccccgtacgtggggtccgggtaaaaaagaaaccgggggtcgcacgccccccctccgcgcaggatcgtgtgcacgaaaaagagctcgggctggccgagcgtatcggccaggaggtcctggaggggggtgctgtggcggtcggccagcacgaccagggaggccagaaaggtgcggtgctcaaagatcgtattgatctgctgcacgaaggccaggatgagggcctcgcggctgacggtggccagccgcccgtcgcccgcgctgcacgcggggcagcagcccccgatccccaggtagtagcccatgcccgagagggtcaggcagttgtcggccacggtctggtccaggctgaaggggagcgacacgggggtcgtcttcaccaggggcacggagagcgagcgcacgatggcgatctcctcggagggcgtctgggcgagggcggcgaagaagccgcggtagcgacggcgctcgtgcaggcagagctccagcctgcgcgcgtgcgacggcaggctcttgcgggaggcccggcgctccacgccggggttcccggcggcggaaaagcgcgaccgccgccgggtcttgtcgcggccgggcccgggccgggagccggagcgacggggggcgatgtcatacataggtacagagggtgtgctccagggacaggagagagatcgagtgtcgtctgagcagcgcgccggcctcgcggacaaatgtggccagcgcggtgggcttcggcacaaatacctggtacgtcttgaaggtgtagatgagggcccgcagggctatacagacccgcccctcgaactcgttgccgcaggccaacttggccttgtgaagctgcagctcgtcgcgatggtcggcgcgggggtggccaaacaggacccaggggtcgacttccatctccgtgatggcgcacatcggatcgcagaacatgtgcttgaagatggcctcggggcccgcggcccgaagcaggctcacgaaccggcccccgtccccgggctgcgcctcggggtccgcctcgagctggtccacgaccggcactatgcagtcgaagaggctggtgttgttctccgagtagcggacgacggacgccctcaggcgtcgcatggccagccagtaggcccgcaccagcaacagattgcacagcaggcattccccgccggtgcgcccgcggccccggccgtgcttcagcacggtggccatcagcgggcccaggtccaggtcgggctgggcctggggctcggcgaactgcgcaaaacgcggggccgcgtcgcgcatgcgcgccccgcggtgcgcttcccaggactcgctgaccgcggcgcggcgggcgtccgcggcggcgcgcagccggggccccgactcccagacggcgggggtgccggcgagcagcagcaggatcaggtcggcgtacgcccacgtctccggctcacccccctgcgccagcgccccggcggcggcctcgaactccccgttgcgggcggcggcgcgcgtgcagcagctgtctccgcccccgcgcttgccctcggtgcagtcgagcaggcgggcgcagtccttccagttcatcagggcggtggtgagggagggttgcgttcccgagcccccgcccgcccccgcccccgccccgtcatcgcccccggaggccagggtcccgatgagggcccgggttgcggactgcgcgaggaaggaatagttggagtactgcaccttggcggcgcccggggagggcgtcggcctgggttgcttctgggcgtggcgcccgggcaccccgccgtcggtccggaagcagcagtggagaaagaaatgccggtggatgtcgttgatggtcagggcgaagcgcgcgaaggagccgacaagggtcgccttcttggtgcgcaggaagtggtggtccatgacgtagacgaactcgaaggcggccacgaagatgctcgcggcgcagtggggcgcgcccaggcacttggcgcagaggaacgcgtaatcggccacccactggggcgagaggcggtaggcctgcttgtacagctcgatggtgcggcagaccagacaggggcggtccagcgcgaaggtgtcgacggacgccgcggcgaagggccccgtgtccaagagtccctctgccgtggggtctgcgggcgggccgcgggcggaccccggcccccgcccccccgaagcctcgcgcgcggccccgcgcggccgcgggggggcgggcgcgacgtcgctctccacgtcctcgtcgagcgcgctcgcgggcggcacgcctaccacgtgacaggccgccaggagctcggcgcacagggcctcgttaagagccagaaggtcgggatcgaaggccacatacggacgctcgaacgcgccctccttccagctgctgcccggcgactcttcgcgcacggcggcgctcgacggcacccccggggcggacgtcgccatggccggtcgagcggggcgcacgcgtccgcgaacgttacgggacgcgatccccgactgcgcgctgcggtcccagaccctggaaagtctagacgcgcgctacgtctcgcgagacggcgcgggggacgcggccgtctggttcgaggacatgacccccgccgaactagaggttatattcccgaccacggacgccaagctgaactacctctcgcggacgcagcggctggcctccctcctgacgtacgccgggcctataaaagcgcccgacggccccgccgccccacatacgcaggacaccgcgtgcgtgcacggcgagctgctcgcccgaaagcgcgaacggttcgcggcggtcattaaccggttcctggacctgcaccagatcctgcggggctgacgcgcgcttcggcggggcaccggcaccgggaccgacttgttttacataacagtagggggtgggggaacgcgcacccttgcccggtcgcgatggcggggatggggaagccctacggcggccgcccgggggacgcgttcgagggtctcgttcagcgcatcaggctcattgttcccgccacgctgcgcggcgggggtggggagtcgggcccctactcgccatccaacccgccctcgagatgtgccttccagttccacggccaggatgggtccgacgaggccttcccgatcgagtacgtcctgcggctcatgaacgactgggccgatgtgccctgcaacccctacctgcgcgtgcagaacaccggcgtttcggtgctgtttcaggggttttttaaccggccccacggcgccccggggggcgcgatcacggcggagcagaccaacgtgattctgcactccaccgagacgacgggactgtccctcggagacctggacgacgtcaaggggcgcctcggcctggacgcccggccgatgatggccagcatgtggatcagctgctttgtgcgcatgccccgggtgcagctcgcgtttcggttcatgggccccgaggacgccgttcgcacgcggcggatcctgtgtcgcgccgccgagcaggccctcgcccgtcgccgccggtccaggcggtcccaggatgactacggggcggtggtggtggcggcggcgcaccactcttccggagcgcccgggccgggggtcgccgcctcgggcccgccagcgccgcccggacggggaccggcccgtccgtggcatcaggccgtgcagttgttccgggccccgcgtccgggccccccggcgcttctgttgctggcggcggggctgtttctgggggccgctatctggtgggcggttggcgcgcgcctatgaaagggggcgagccaccgtcccgcccgccagtgcatcccagacgcccgcgagccgcacatcccctccgctcccgcctccggcccgattcttacggcgcgacccaaggtcccgatggccgccccgcagtttcaccgccccagcaccattaccgccgacaacgtccgggcgctcggcatgcgcgggctcgtgttggccaccaacaacgctcagttcatcatggataacagctacccgcatccgcacggaacgcagggtgcggtgcgagagtttcttcgcgggcaggccgcggcgctgacggacctcggggtgacccacgccaacaacacgttcgccccgcagcctatgttcgcgggcgacgccgcggccgaatggctgcggccctcgttcggtcttaagcgcacgtattccccctttgtcgttcgcgaccccaagacccccagcaccccgtgagtcctcggcgggtccctccgcggccgtctctcgttgcccccctttcccccttcccgggtggttcaataaaaaacaccaacatacgatattcgcgtttgatacgtttattggggggggtgtagggcccaacgatcggcgattaacaacaccaaacaatcgagcgcgtctaacccagtaacatgcgcacgtgatgtaggctggtcagcacggcgttgctgcgctgaaacagcgccctgcgggtccgctgcagctgttgttgtatgcggcggcatgcgcggatcaaaaccgccagggcgctacgaccggtgcttcgtacgtagcgtcgcgacaagacggcatttgcctgtacgggcaaggggccaaattgcgagtgtggtgactggaggtggtcggcggccaatgggccgggtggttcgtcggcggggggcaagtgcggttccggtgggagggggtcgagcgcctcggtatcatccgagtccgagaaacgcagggagtctgcgtcggagtgttcatcatcggaggagatgtgcagcgtctgaagcagcgatgcgggtgggggcgcggagtcgacgtgaagcgcgagagaggaagcccacgaagtcacagcggacactgggaggtgggtgtttgtatgtgtgggagactcgggcgtcgggaccgagtctcggctctggggtgtaagcgtccgagttacgggcggcaggggcggctggggcaggggcggctggggcaggggcggctggggcaggggcggctggggcaggggcggctggggcaggggcggctggggcaggggcggctggggcaggggcggctggggcaggggcggctggggcaggggcggctggggcaggggcggctggggcaccgagcgcgcgcggatgcgcgtccgcgcggcgggtttggtcgcgggtgactggggtggggggcggcgggcaaccgggcctccgggcacgacccaaccgcacaaaggctcgctcggggcaaccgggcctggggccaaaggcggggggctggtctggacggcggaggtcgggggggcaaggcccggagaaggcggcactgccgccgctgcggcggaaaccgcggccgcgtggtcggctgggtcccggggagaggggagggagttcaacgaggccgagagcgaggcgaccgcggggcgcgtgaggcgccggggtgggccggccgcggggccccgggggggtgtcggcgagggacccgctgttgtctggcggcggccgcggcggcggtcgcccccggggacgaccgctccttcggcgggcggaggcgggatgggcgcgagcgtgggggcgggaaaggccccgcgagccgaggcggggccgggcggaaggggcaaagcagaaacccaagccgggggcgcggactccggggtgggcggctggtcgggaggacgcgcggaagcggcgaccggggcgaccggggcggggagtgccggcggacgccacccctcggggggggcggaggcccggggcgcgcgcgatttggcacgcgtccggcgggacctgcgcacgcgcggcacggcggcggagaaagcggcggcagagccggaaaaggccgggggaggaagcgcggcatccgcggggggactcggtgtgggtggcgagggccgtgggtcgtcgcgaggggccacgggcacgcgccccgtgttttgttgaggcgggacactcggtcgtgtttcgcgagccgtagctgccggcccgatgggccgcggtgcgtactgggacgtggggacggactgatcggtggcgggggggggaagaagggccggggccggattgggcgtggggccgccggcgtcgtcggacgccagctcctccaggccgtggatccaggcccacatgcgaggggggacgggctcgccggtggtggcgtcggtgaggagagtgggggcgaggacccccgggtccgcctgccgtgcggggggggcagcggggtcctcgggacccgatccgccatccccccccgcaaggtcccgcgggtcgcgggcggcggtcggggcagagggacctgcctcgtcggcgagggggcgctggtaaaccgggtgtcccgggaacagctcccccgtcaggagggaggcgtcgaagggccgcccgaggatggcccgcgcgaagaaggggtccgcgtcggcggcgctcgccgcgagaacgtcccccgcggtagccacaaacggaagctcctcggtggcctcgctgcccacaaaccgcacgtcaggggggccggggggctccggggcttcccacaagaccgcgaccggggtcatggagatgtccacgaggaccaggcacgggggcccgtcggcgagagggcgctcggcgatgagcgccgacaggcgcgggagctgcgccgccagacacgcgttttcgatcgggttgagatcggtgtggaggaggccgacggcccacgtctcgatgtcggacgacacgacgtcgcgcagggcggcgtccggcccgccggggcgcgagtcgaagagcgtcaggcacagttccagttccgactcgcgggagaaggccgtggtgttgcggagcgccaccacgacgggcgcgccgaggagcaccgcggccagaaccaggtccatggccgtaacgcgcgcggcgggggtgcggtgggtcgcggcggccagcacggccacgtgctggcccgtgggtcggtagagggcgtggggggcctcggggagggacgccttgcgcccccccgccgggccgagcgtctggccagactccaggcgtgcggccaggagggcgtcgaagctgtcgtactcggtgtagtcgtcgggaaacatgcaggtccacagcgcggccaaagcggcgctcggcagacacatgcgcccgaggacgctcaccgccgccagggcctgggccggactgagcttcccgagcgccgggacgtcccggcgctgggtcccgagctccaaggccgagcgccagggcgccagcgggtcggtttcggacagcttgccccggcgccagtcggccagccgcgtgccgaacaggaggccccgggtcggggggcctccgtccaaaaacgtcggcaacacgcggatgcgggcgtcgggatgcggggtcaggcgctggacgaacagcatggactccgctgcgtcctcgaacgcgcgttcgagggtgaggtgcatgtactcgtgctggcgaacgaggtccaggcgccagaagttgtagatgtgttccggaacgccggccaccagcgcgaccagcacgtcgttctcgttgaaggcgacgcagtggcgctgggacccccgggggcccggcggcggacgcggcgccgccgctccggacgcccagcccagctgggcccagcgacacccaaactcgcgcgtgagggtggtggcgacgagggcgacgtacagctcggccgccgcgtccatcgaggcgccccacgtcgcctggcgatggcgcacgaagcgaccgaacagctgaaagttggcggcctgggcgtcgctgagggccagctggagccggttcacgacggtcagcacgtacatggccgtgaccgtcggggccgattcgaggacgtccgtcggaagcgggggccgcacgcaggccgcctcgggacgcatcagcagcgcgccgagtttgtcggtgacggccgggaagcatagcgcgtactgcagcggcgttccgtccggggccaaaaagctggtggcgaacggcagatccagagcgctgacggcctcacgcagcaccaggggccccgggtctccgccggcgcgcagatacgcctcgccccggcggcgcagcagctgcgggtcgacctcgtggccctcgggggaagaagaggcccgggcgcgggcgtcgagggcgcgaagatcaacgagcaggggcgcgggcgcggactccgcgcccgcgcccgtctggccgccggccctggcgtacgcgctatataagcccatgcggtattggatgagttcccgcgcgccccggaactcctccaccgcccacggggccaggtccgcggccgccgcgtcgaactccgccagcaggcgccccagggcgtcaaagttcatctcccagggcaccctgcgcaccacctcatcccgcagccgggcgcacagggcggtgtgcttggtgacgcgcgcgcccagctcctccacggcctccgcgcgctcggcgcccttggcgcccaggacgccctggtacctggcggaaaggcgctcgtaggccggctgggcccgcagccccgacaccgtgttggtggtgtcctgcagggcgcgcagctgctcgtgcatggcgcggaacccctcgggggacttccaggcgcccccccggacgcggccaaagcgaccccagacctcgtcccactccgcctcggcctcctccagggacctccgcagggcgtcgacgcggcgccgagtatcaaagagcgcccccaggcggccggcgtgccgcgccagggggccggggccgtcgccgcgggcggcgcttagcgggtgcgtctcgaaggtgcgctgggcgtgctctagccagataaccgcgggcacgtcgagctcgcgcgttttctcggtctgatccaacagaacctcgacctggtcggcgatctccgccaccgagcgcgcctggtcgagcgtcttggccacggtcgccgggacggcgaccaccttcagcatggtcttgaggttggccaggccctcggcctcgatctgggcccggcgctcgcgcgcggccagcgcctcccgcaggcccgccatgacccgctcggtggcctccgcgcgctgctgtttggcgcgcaccactgcgtccttggtctcggccgtgtcctgccgggtcacgaaggcgacatactcggcgtacgccgtgttcttcacggggctctggtccacgcgctccaacgccgccgcgcacgcgaccagcgcgtcctcgctgggacacggcagggtgaccccggtccggaccagctccgcggtggcctccgggtcattccgggccgcggatatctgctccgcggcggccgccaggtccaggggcacgccgccgagcgcccggtgcacgtcggcccggatggcgtccaggcgatcgcggagctccacgtagtcggcgtagccatgttggaagaacggcacgtaccggcgcaggccgggcacgctcgtcatgtcgtccgccaggcgccccacggcctcgtggtagtcgataaacccgtcgcccgcctgggccatttccaggagcccctccgcgatgcgcagcagccgcgccaggggctcggcgtcgacccgaaacatgtcggcgtaggtttcggcggcggcgtggaacgccgcgctccagccgaggcggtggatggcggcgagcggggggagcatggggtggcgctggttctcgggggtgtaggggttaaacgcgaaggccgtatccagggcgagggtgaccgcctcggcgttggccgcgagcgcctgctcggcgcgcttgcggaagtcccgggggttgtagccgtgcgtgcccgccagcgcctgcaggcggcgcagctcgaccacgtcgaactcggcgcggttctcgacgcggtccagcgccgcctcgacgccggcggcccagcgctcgctgctgccccgggcgcgctgggccgccatcttcgccgtcaggtcggcgacggcggcctcaagttcgtcggcgcggcgtcgcgtggcgccgatgaccttgcccagctcctgcagggcgcgcccgctgggggaatggtccccggccgtcccttcggcgtgcagcaggcccccgaacccagcctcgtgccccgcgaggctttcccgagcagcggtcgtcgcgcgggccgcggcatcgatgagggcggcatggtccccctccggctgggcgcaggcccggcgcgcctggactaccaggtcggcggccgccgaccccagggtcgtgagctcgtcgatggccccccgcgcctccagggccagccgagtcgcctttacataccccgcggcgctatcggccagcaccgcgaggaaggacaggggcgaggccgggtcgcgggcggccgcgcccagggccgacaccgcgtccgccagggcgccatgcgcccgcacggccgcgtccaccgtcgccgcgggacttgccgtcgcgacggcggcgctcccggcgttgatggcgtttgacacggctttggcgattgtgggggcgtgatcggaaaagaactgcacgaggaccggcgtctcgggggcgtcggcgaacagggtcttcagcaccaccacgaaggcgggatgcaggccggccagagccgtcgcggtatccggggtcgggtgttccagggcctcccggtactgccccagcagcccccacaggtccgcccgcagcgccgccgtgacttccgggggggggccccggacggcatcggccaggtcggtccaccccgcgggcagggaggcccgcagggtcgccagcacggccggacacgcctttagccccacaaagtccgggaggggccgcaggaccccttggagtttgtgcaggaacttctcccgggcgtcgtgggccaccttggcgcgctcccgcgcgtcgttgagcatcgcctccagggcgtgggcgcgctcccgaagccgggagcgcgcctccggagcgagctccgccgtcatcttggccgcctccatggccctcgcctgccgcagcgcgtcttcggccatgcgcgtggcctcgggggacagcccgcccccgtcgacgtacggcgcggggccggtcgccgggacgaaggccgcgtcgctgtccagctgctgcgcgagcgccgcgtcgagggcgtcgaagcgctgcagttcggccagccccgagctgcgccgcgcctgctggtcgttgatgccgtggatgctgcgcgccagctcttccaggggcttgcgttcgatgagcccctgggtcgcggcgtcggtcaggaccgagagccaggccgccaggtcctcgggggcatctagggtctggccccgctggagcaggtcccgcagcaggatggcctgggggctggtggcgagggggggcgggggggggagcgcggcgcgctgagcgacgtcccgcgtgtgttggtcaaaggccggtagcgattccagcaactggaccatgggcacgaccgcggccgaggccacgtgaaaccgacagtcgtggctgtcgctggcctgcagggccttcgcgctgtatacggctccccggtggaagtactccttgaccgcgctctcgatcgcccggcgggcctggatccgcacgtcctccagccgcgcctggatggcctcggggcccagggcgggcgggcacggggccctgccgccggcgcccggggcggcgggcacgggcatcacggtcaggggcccggcgcgctgcgagaccgagtcgaccccgcgggcgagggcgtctaaggcctcgcgcatctcgcgggcctccgcctcgacccgcatctcttcgccccgggcaaactgggccagcgcctggatccgatggagaagcggctccgggtgcgtcggggtggcgggggcgaacagggtgttcgggtgggcgcgcgagcgctccaggagccactctccgaggcgtgcgtacagattggccggcggggcggcgcgcagctgcagatccaggtccgcgaggtccccgtaaaaggcgtccgtctcccgaataacgtccctggcgaccaggaccagcttagcgagggccaggcgcccgatctgcgaattttcgtccagcacgtgctggatgaggggccggtgggcggccacgtccgccaggctcatgcgcgtggacgccaggaagtccccgacggccgttttgcggggcagcatgcgcagggtgaagtccagcagggccgcggccgggccggccaccccggcctgcgtatgcgtgcgggccccgttctcgatcaaaaaggcgaggacgcgctcaaagaagaagatgacgcagagctccaacagccccgggtgcgccgggtacggcgaccgcagggcgttgatggtgagctgcgaacacgcggccacctcgcgggccagggcggcatcgcgcgccgcgagccggaccgccgtggcggccacattggggtggacctcgaacagctgcgccaggtcggcgccggggggctccggggggcggcgggcccccagcgtctcgagcacggacggcgacgacgggctcgcgggcccgtcgtcgccgccgccctgcccggactgcgggggggtatccggtgcgggagggaccgtggcggctatgggcgtcggggaggaggcggggacctcggcggcgacgggggccttcttcttgggcgcggacttcttcttggccttggcgggcggggccttgggggcgggcctctcgcccgaggtcagatcctccacgctggacggtggggtccaggtgggccggcggcgcttgggcaagccggtagaatagcgcgcccggtggcgacccaccggcactgcccccacctccaggacccgcaggtcctcggcttcttcggccgcgtccccggcgggtgtctgcgggggcggggcggcgtgcggtggacccgaggccgcggcgtccggggccgagggcttcgcgggcggggtcccctccagggctgctgcccacacatcatcgggggggcggtttgggtgccccgcctgcggtgtgtcgggtgggcccgaggccccccggggggcctcggggggccggtcggccccaggggtctggacgtgggtgggcgcggggagcgcggggacgaccgggcccgagccttctccgtcccccctggggaccacaccgacaaagagcgccccgagccccccgatctcgccccgcagggggtgggtgatggccacgcgccgctcgacgaacggttcgtcctgcaggtaagtctcgctggccccgtagaggtgcagggccgcggcggtcaggtccgccggcgccacggcccccgggccggagggcacaaaaaacaccatggcgcccgcccaccgcaccttggggcggtcgtgggcgtaatacgtcaggtacgggtacacgtcgcccgcccgcaccttggcgataaacgcgggcgttcccgcgggcaggccgtgcgggtcaaacagataggccgtgtcgccgtcccggtagagccccatgcccagggggccgatggtcaggagcgtgtaggacagcggccgcatggcccaggggccggcgaagaacgtgtgcgcggggcattgcgtctccagcagccccgccgtgggctccccgaagaagcccacctcgccgtacacccgcgaaaacacgcaacgcaggccgccgcgcgccgccgggtactccaggaagttggggagctcgataatggaacacatgcgcggcggcccggagcccgcggccgcgcgcgtccactcgcccccctccaccagacatccctcgatggcctccgcggacagcacgtcgcggggccccacgtcgaaaagaagactgagaaacgacagggacgagcgcatgcacgataccgacccccccggctccagatcggtcgcgaactggttccgaacaccggtgaccacgatatcgcgatccccctggcgcttcatcgtggggtgaggtagcgcggccggaatcatgtgtgccgcgcccgccacgagcggggcctgtttatgggccgggcgtcccgatgagtactgttgtttccgccgcccgaacccccccgcccatcaaccgcctgttcgtccccctaaccacacacccggtatcgcgtgtgtgtggtttcccgggaagacacatcccaccccatgaagttttgccctttttttccgtcccgcactacgccacctttccaccccccccccaaaaaaacaacaaccaactcccagatggatgggtgcgataataaagctttattattgtttaaccaaaggcgagtcctacgggtgtaccggtggtgtctcctgcggcgtcatctcgtcgtcctccacgggggtgttgggccaagggaccgtctcgcggcccgccgggcgcgtcgacggcgcgcgggcctgcgtgtcctgtgggccgggtgtcgtgggttcgggggtgctaccgccggcatcttgggcctccaggtccccgggggcccccgggccggcggaaggccgaaacgccgaggcgcgaaacacgccgtcggtgacctgcaggagctcgtttattaatagccagtccatgctcagcgtagcggccagcccctggggagacaggtccacggagtccggaaccaccgtcggctgacccaggggccccaggctgtagtccccccaggcccccaggtcatgacggttcgtgagcacgacgaggtctgcggccgggctggggggcgcgtcctcggtcgcgtgggccatcacctcctgaatggctgcggtgcgctgatcggccgagctggcgaagggcgccacgaccagcgcgcgctccgtctgcaggcccttccacgtgtcgtggagttcctgaacgaactcggccacccgctcggggcccgtggccgcgcgtgcggcctgatagccggccgagaggcgccgccagcgcgccaggaactgactcatgtaacagaacccggggacctggtcccccgacatcaactttgacgccctggcgtggatgcccgacacgatggccaggaacccgtggatttcccgccgcacgacggccagcacgttaccctcgtgcgagacctgggccgccagctcgtcgcataccccgaggtgcgccgtcgtctcggtgacgacggaccgcagccccgcgagggacgcgaccagcgcgcgcttggcgtcgtgatacatgccgcagtactggctcaccgcgtcgcccatggcctcggggcgccagggccccaggcgctcgtgggcgtctgcgaccacggcgtacaggcggtgcccgtcgctctcgaaccggcactcaaagaaggcggcgagcgtgcgcatgtgcagccgcagcagcacgatcgcgtcctccagctggcggaccagggggtcggcgcgctcggcgagctcctgcagcaccccccgggccgccagggcgtacatgctgatcagcagcaggctgctgcccacctcgggaggctgggggggaggcagctggaccgcgggccgcagctgctcgacggcccccctggcgatcacgtacagctcgcgcagcagctgctcgatgttgtcggccatctgcatcgtgggcccgacgccggcccgggtggccggttcgaggagggtgatcagcgcgcccaattttgtgcggtgcccctcgacggtggggagatagcccaggccgaagtcgcgcgcccaggccagcacccgcagggcaaactcgatggggcggggcaggtaggcagcgttgcacgtggccctcagcgcgtccccgaccaccagggccagcacgtaagggacgaaccccgggtcggcgaggacgttggggtggatgccctccagggccgggaagcggatcttggtggccgcggccaggtgaaccgagggggcgtggctaggcggcccgacggggagcagcgcggacagcggcgtggccggggtggtgggggtcaggtcccagtgggtctggccgtacacgtcgagccagatgagcgccgtctcgcgcaggaggctgggctggccggcgctgaagcggcgctcggccgtctcaaactcccccacgagcgtgcgccgcaggctcgccaggtgttccgtcggcacggccgggcccatgatgcgcgccagcgtctggctgaggacgccgcccgacaggccgaccgcctcacagagccgcccgtgcgtgtgctcgctggcgccctggatccgccggaacgttttcacgtagccggcgtagtgcccgtactcccgcgcgagcccgaacacgttcgcccccgcaagggcaatgcacccaaagagctgctggatctcgctgagcccgtggccggggggcgtccgcgcgggcacccccgccaccaaaaacccctccagggccgatatgtactgggtgcagtgcgcgggcgtgaaccccgcgtcggtaagcgtgttgatcaccacggagggcgagttgctgttctggaccaaagcccacgtctgctgcagcagcgcgaggagccgttgctgggccccggcggagggcggctcccctagctgcagcaggccggtgacggccggacggaagatggccagcgccgacgcactcagaaacggcacgtcggggtcgaagacggccgcgtccgtccgcacgcgcgccatcagcgtccccgggggcgcgcacgccgaccgcgggctgacgcggcttagggcggtcgacacgcgcacctcctcgcgactgcgaaccattttggtggcctcgaggggcgggatcatgatagccgggtcgatctcccgcaccgtgtgctgaaactgggccagcagcggcggcgggaccaccgcgccccgatcgggggtcgtcaggtactcgtccaccagcgccagcgtaaacagggcccgcgtgaggggggtcagggcggcgtcgtcgatgcgctgtaggtgcgccgagaacagcgtcacccaattgctgaccagggccaagaaccggagaccctcttgcacgatcggggacgggaagagcaggctgtacgccggggtggtcaggttggcgccgggttgccccaggggaaccggggacatcttaagcgacatctccccgagggcctccagggaggtccgcgggttcatggccaggcagctctgggtgacggtccgccagcggtcgatccactccacggcacactggcggacgcgcaccggccccagggccgccgtggtgcgcagcccggcggcctccagcgcgtgggtcgtgtcggagccggtgatcgccaggaccgtgtccttgatgacgtccatctcccggaaggccgcctcgggggtctcggggagcgccaccgccatgcggtgcaccagcagcccggggaggttctcggccaagagcgccgtctccggaagcccgtgggcccggtgcaaggcgcacagttgctccaggagcgggtgccagcacgcccgcgcctccgccgggccgaccgccgcgcccgacaacagaaacgccgccgtggcggcgcgcagtttggccgcggacagaaacgccggctcgtccgcgctgcccgccggctcgctcgagggggagggcggccggcggaggttggtcaggctccccaacaggacctgcaacggtccgtttgggggtggagcggacgggggggtcatgccggcgggcgccgggacctggagcgcgctgtccgacatggcgaccggcgtgcgcgctcggcgacgcggcgcggagaccgcgggcccaaacgggaatgactgccgccgccctatacggaggggctaagtatcgcccggggacccttcgaaaccccgggcgtgtcgcaagtacgccgcgaaggcgcggcgtgttatacggcgcgttatgtcccggcattccgttcgtgggttcgggcccgggtgctgtcgggtgggagtgtgtgtgggggggggcggcgcgacggcggcccggaccaagtgtatcgcggccgttccgtggggcggcccaacaggccctttaaacatttgcgtatgcaccggcccagccagtcggacaccggaacccaccagaggcggaagccgccttcgcccgtgagggtgcgtgtgttttctggtggcgtgtttttcctttccgccctcctccctccccacctccaccacccccccccacaactcgcccgttggcgatcggcgggaaaaccatgaaaaccaagccactcccgacagccccgatggcgtgggccgagagtgccgtggaaaccaccaccagcccgcgcgagctcgcgggccacgccccgctccggcgcgtcctgcgcccgcccatcgctcgccgcgacggcccggtgcttttgggggacagggcccccaggaggacggccagtacgatgtggctgctggggatcgaccccgcggagtcgtctccgggaacgcgcgctacccgagacgataccgagcaggccgtggacaagatcctcaggggagcccggcgcgcgggagggctgaccgtccccggcgccccccgctatcacctgacccgccaggtaaccctgacggatctctgccaaccaaacgcggagcgggccggggcgctccttttggccctgcggcaccccaccgacctcccccacctggcccgccatcgggctccgcccggccggcagaccgagcgactggccgaggcctggggccagctcctggaggcctccgccctggggtccgggcgggccgagagcggctgcgcgcgcgcgggccttgtgtcgtttaactttctggtggccgcgtgcgccgccgcctacgatgcgcgcgacgccgccgaggcggtccgggcccacatcacgaccaactacggcgggacgcgggccggggcgcggctggaccggttttccgaatgcctgcgcgccatggtccacacgcacgtgtttccccacgaggtcatgcggtttttcggggggctagtgtcgtgggtcacacaggacgagctggctagcgtcaccgccgtctgcagcggaccccaggaggccacacacaccggccacccgggcaggccccgttcggccgttaccatcccggcctgcgccttcgtggacctggacgccgagctgtgcctggggggccctggggcggcgttcctgtacttggtcttcacctaccgacagtgccgggaccaagagctctgttgcgtgtacgtggtcaagagccagctccccccgcgcggactggaggcggccctcgagcggctgttcgggcgcctccggataaccaacacgattcacggggccgaggacatgacgccccctcccccgaaccgaaacgttgactttccgctcgccgtcctggccgcgagctcgcaatccccgcggtgctcggcgagccaagtcacgaacccccagtttgtcgacaggctgtaccgctggcagccggatctgcgggggcgccctaccgcacgcacctgcacatacgccgccttcgcagagctgggtgtcatgccagacgacagcccccgctgtctgcaccgcaccgagcggtttggggcggtcggcgttccggttgtcatcctggagggcgtggtgtggcgccccggcgggtggcgggcctgcgcgtgatcgtctattgacgacggccgcccaacccgagcgaccttcccctcccacttccccccccctacacaccaactccgccctcgccgtcttggccgtgcgcggccccgtgcgtccgtctcaataaagccaggttaaatccgtgacgtggtgtgtttggcgtgtgtctctgaaatggcggaaaccgacatgcaaatgggattcatggacacgttacacccccctgactcaggagataggcatatcctccttagattgactcagcacacgatcgcaccccacccctgtgtgccggggataaaagccaacgcgggcggtctgggttaccacaacaggtgggtgcttcggggacttgacggtcgccactctcctgcgagccctcacgtcttcgcccaccgattcctgttgcgttcctgtcggccggtgctgtcctgtcgacagattgttggcgactgcccgggtgattcgtcggccggtgcgtcctttcggtcgtaccgcccaccccgcctcccacgggcccgccgctgtttccgttcatcgcgtccgagccaccgtcaccttggttccaatggccaaccgccctgccgcatccgccctcgccggagcgcggtctccgtccgaacgacaggaaccccgggagcccgaggtcgccccccctggcggcgaccacgtgttttgcaggaaagtcagcggcgtgatggtgctttccagcgatccccccggccccgcggcctaccgcattagcgacagcagctttgttcaatgcggctccaactgcagtatgataatcgacggagacgtggcgcgcggtcatttgcgtgacctcgagggcgctacgtccaccggcgccttcgtcgcgatctcaaacgtcgcagccggcggggatggccgaaccgccgtcgtggcgctcggcggaacctcgggcccgtccgcgactacatccgtggggacccagacgtccggggagttcctccacgggaacccaaggacccccgaaccccaaggaccccaggctgtccccccgccccctcctcccccctttccatggggccacgagtgctgcgcccgtcgcgatgccaggggcggcgccgagaaggacgtcggggccgcggagtcatggtcagacggcccgtcgtccgactccgaaacggaggactcggactcctcggacgaggatacgggttcggagacgctgtctcgatcctcttcgatctgggccgcaggggcgactgacgacgatgacagcgactccgactcgcggtcggacgactccgtgcagcccgacgttgtcgttcgtcgcagatggagcgacggccccgcccccgtggcctttcccaagccccggcgccccggcgactcccccggaaaccccggcctgggcgccggcaccgggccgggctccgcgacggacccgcgcgcgtcggccgactccgattccgcggcccacgccgccgcaccccaggcggacgtggcgccggttctggacagccagcccactgtgggaacggaccccggctacccagtccccctagaactcacgcccgagaacgcggaggcggtggcgcggtttctgggggacgccgtcgaccgcgagcccgcgctcatgctggagtacttctgtcggtgcgcccgcgaggagagcaagcgcgtgcccccacgaaccttcggcagcgccccccgcctcacggaggacgactttgggctcctgaactacgcgctcgctgagatgcgacgcctgtgcctggaccttcccccggtcccccccaacgcatacacgccctatcatctgagggagtatgcgacgcggctggttaacgggttcaaacccctggtgcggcggtccgcccgcctgtatcgcatcctgggggttctggtccacctgcgcatccgtacccgggaggcctcctttgaggaatggatgcgctccaaggaggtggacctggacttcgggctgacggaaaggcttcgcgaacacgaggcccagctaatgatcctggcccaggccctgaacccctacgactgtctgatccacagcaccccgaacacgctcgtcgagcgggggctgcagtcggcgctgaagtacgaagagttttacctcaagcgcttcggcgggcactacatggagtccgtcttccagatgtacacccgcatcgccgggtttctggcgtgccgggcgacccgcggcatgcgccacatcgccctggggcgacaggggtcgtggtgggaaatgttcaagttctttttccaccgcctctacgaccaccagatcgtgccgtccacccccgccatgctgaacctcggaacccgcaactactacacgtccagctgctacctggtaaacccccaggccaccactaaccaggccaccctccgggccatcaccggcaacgtgagcgccatcctcgcccgcaacgggggcatcgggctgtgcatgcaggcgttcaacgacgccagccccggcaccgccagcatcatgccggccctgaaggtcctcgactccctggtggcggcgcacaacaaacagagcacgcgccccaccggggcgtgcgtgtacctggaaccctggcacagcgacgttcgggccgtgctcagaatgaagggcgtcctcgccggcgaggaggcccagcgctgcgacaacatcttcagcgccctctggatgccggacctgttcttcaagcgcctgatccgccacctcgacggcgagaaaaacgtcacctggtccctgttcgaccgggacaccagcatgtcgctcgccgactttcacggcgaggagttcgagaagctgtacgagcacctcgaggccatggggttcggcgaaacgatccccatccaggacctggcgtacgccatcgtgcgcagcgcggccaccaccggaagccccttcatcatgtttaaggacgcggtaaaccgccactacatctacgacacgcaaggggcggccatcgccggctccaacctctgcaccgagatcgtccacccggcctccaagcgatccagtggggtctgcaacctgggaagcgtgaatctggcccgatgcgtctccaggcagacgtttgactttgggcggctccgcgacgccgtgcaggcgtgcgtgctgatggtgaacatcatgatcgacagcacgctacaacccacgccccagtgcacccgcggcaacgacaacctgcggtccatgggcattggcatgcagggcctgcacacggcgtgcctgaagatgggcctggatctggagtcggccgagttccgggacctgaacacacacatcgccgaggtgatgctgctcgcggccatgaagaccagtaacgcgctgtgcgttcgcggggcgcgtcccttcagccactttaagcgcagcatgtaccgggccggccgctttcactgggagcgcttttcgaacgccagcccgcggtacgagggcgagtgggagatgctacgccagagcatgatgaaacacggcctgcgcaacagccagttcatcgcgctcatgcccaccgccgcctcggcccagatctcggacgtcagcgagggctttgcccccctgttcaccaacctgttcagcaaggtgaccagggacggcgagacgctgcgccccaacacgctcttgctgaaggaactcgagcgcacgttcggcgggaagcggctcctggacgcgatggacgggctcgaggccaagcagtggtctgtggcccaggccctgccttgcctggaccccgcccaccccctccggcggttcaagacggccttcgactacgaccaggaactgctgatcgacctgtgtgcagaccgcgccccctatgttgatcacagccaatccatgactctgtatgtcacagagaaggcggacgggacgctccccgcctccaccctggtccgccttctcgtccacgcatataagcgcggcctgaagacggggatgtactactgcaaggttcgcaaggcgaccaacagcggggtgttcgccggcgacgacaacatcgtctgcacaagctgcgcgctgtaagcaacagcgctccgatcggggtcaggcgtcgctctcggtcccgcatatcgccatggatcccgccgtctcccccgcgagcaccgaccccctagatacccacgcgtcgggggccggggcggccccgattccggtgtgccccacccccgagcggtacttctacacctcccagtgccccgacatcaaccaccttcgctccctcagcatcctgaaccgctggctggagaccgagctcgtgttcgtgggggacgaggaggacgtctccaagctctccgagggcgagctcggcttctaccgctttctgtttgccttcctgtcggccgcggacgacctggtgacggaaaacctgggcggcctctccggcctcttcgaacagaaggacattcttcactactacgtggagcaggaatgcatcgaggtcgtccactcgcgcgtctacaacatcatccagctggtgctctttcacaacaacgaccaggcgcgccgcgcctatgtggcccgcaccatcaaccacccggccattcgcgtcaaggtggactggctggaggcgcgggtgcgggaatgcgactcgatcccggagaagttcatcctcatgatcctcatcgagggcgtcttttttgccgcctcgttcgccgccatcgcgtacctgcgcaccaacaacctcctgcgggtcacctgccagtcgaacgacctcatcagccgcgacgaggccgtgcatacgacagcctcgtgctacatctacaacaactacctcgggggccacgccaagcccgaggcggcgcgcgtgtaccggctgtttcgggaggcggtggatatcgagatcgggttcatccgatcccaggccccgacggacagctctatcctgagtccgggggccctggcggccatcgagaactacgtgcgattcagcgcggatcgcctgctgggcctgatccatatgcagcccctgtattccgcccccgcccccgacgccagctttcccctcagcctcatgtccaccgacaaacacaccaacttcttcgagtgccgcagcacctcgtacgccggggccgtcgtcaacgatctgtgagggtctgggcgcccttgtagcgatgtctaaccgaaataaaggggtcgaaacggactgttgggtctccggtgtgattattacgcaggggaggggggtggcggctggggaaagggaaggaacgcccgaaaccagagaaaaggaccaaaagggaaacgcgtccaaccgataaatcaagcgccgaccagaaccccgagatgcataataacgattttattactcttattattaacaggtcgggcatcgggaggggatgggggcgcgcgtttcctccgttccggctactcgtcccagaatttagccaggacgtccttgtaaaacgcgggcgggggcgcgtgggcccacagctgcgccagaaaccggtcggcgatgtccggggcggtgatatgccgagtcacgatggagcgcgctaaatcttcgtcgcggaggtcctgatagatgggcagtctttttagaagagtccagggtccccgctccttggggctgataagcgatatgacgtacttgacgtatctgtgctccaccagctcggcgatggtcatcggatcgggcagccagtccagggcctccggggcgtcgtggatgacgtggcggcgacgtccggcgacatagccgcggtgttccgcgacccgctgcgcgttggggacctgcacgagctcgggcggggtgagtatctccgaggaggacgaccgggcgccgtcgcgcggcccaccggcgacgtccgggggctggaggggggggtcttcttcgtagtcgtcctcgcccgcgatctgttgggccagaatttcggtccacgagatgcgcgtctcgaggccgaccggggccgcggtcagcgtaggcatgctctccagggagcgcgagttggcgcgctcccgccgggccgcccggcgggcctgggatcggctcggggcggtccagtgacactcgcgcagcacgtcctcgacggacgcgtaggtgttattggggtgcaggtctgtgtggcagcggacgaacagcgccaggaactgcgggtaactcatcttgaagtactgcagcaggtcgcggcagtgaatcgtcggaatgtagccggtgctgatgtccaacacgatatcgcagcccatcagcaggagatcggtatccgtggtatgcacgtacgcgaccgtgttggtatgatagaggttcgcgcaggcgtcgtcggcctccagctgacccgagttgatgtaggcgtaccccagcgcccgcagaacgcggatacagaacaggtgagccaggcgcagggccggcttcgagggcgcgcccgagggggccgccgggcctgggccggcggcccgcgttccccggtcccccggggcgaaggcgtgcccgcggcggcgcatgttggaaaaggcgaaactgggcctggagtcggtgatgggggaaggcggcggcgaggcgtctacgtcactggcctcctcgtccgtgcggcactgggccgtcgtgcgggccaggatcgccttggccccgaacacaaccggctcggtacactcgaccccgcgatcggtcacgaagatggggaacagggacttttgggtaaacacccgtaacatactacagagacagtgtagcgtgattgcctcgcggtcgtaacttgggtagcggcgctgatatttaaccaccagggtatacatgacattccacaggtccacggcgatgggggtaaagtagccctccggggcccggaggccccggcgcttcaccagatggtgagtctgggcaaacttcatcatgccaaacagacccattccggcacgattgtaggtgcggataggtctctctacagagctgtataggtgtgacggtccgggacacccaagcccgccgcccctgtgtacagtggctgcggcgacgaccccgctccaacaagacgctatcccgggaaaggcacgctctttataattcttttttatttcccatctacgtgcggattggtgcaaccgccggcgcgcgccggtgcaggccgaccatctctctcttccccccctccccctcccccgagccctcaaagagggtgtggcctaactagcggaaggcgtatttaaccagactagggcggcgggtccgccgtagtccttggctcgggtagccactgctctgtggctcgggtcccccggcccccctaacccccatccggtccgcgtcatccgccccctccgcctgcgacacaaacggccgcgcctccgggcccggtgacacgacgcgcctcgtctctgcggattgtcccgggagcgtcgcggcatggctcatcttcccggcggtgcggccgccgcccccctttcggaggacgcgatcccgtcgccgcgcgagcggacggaagactggccgccctgccagatagtgctgcagggcgccgagctgaacgggatcctgcaggcctttgcgccgcttcgcacgagccttttggactcgctcctggtcgtgggcgaccgaggcatccttgtacataacgcgattttcggcgagcaggtgtttctgcccctcgaccattcgcagttcagtcgctatcgatggggcggacccaccgcggcgttcctgtctctcgtggaccagaagcgatccctgctgagcgtgtttcgcgccaaccagtaccctgacctgcggcgggtggagctgacggtcacgggccaggccccgtttcgcacgctggtgcagcgcatatggacgaccgcgtccgacggagaggccgtggagcttgccagcgagacgctcatgaaacgcgagttgacgagcttcgcggtactactcccccagggcgaccccgacgtccagctgcgcctcacgaagccccagctcacgaaggtggtgaacgccgtcggggacgagaccgccaaacccaccacgttcgagctcggccccaacggcaagttttccgtgtttaacgcgcgcacctgcgtcacctttgccgcccgcgaggagggcgcgtcgtccagcaccagcgcccaggtccagattctgaccagcgcgctgaagaaggcgggccaagcggccgccaacgccaagacggtctacggggaaaacacacaccgcacattctcggtggtcgtcgacgactgcagcatgcgggcggtcctccggcggctccaggtcggcggggggaccctcaagttcttcctcacggccgacgtccccagcgtgtgtgtcaccgccaccggccccaacgcggtgtcggcggtgtttcttttaaaaccccagcgggtctgcctgaactggctcggccggagcccgggttcctcgaccgggagcttggcgtcccaggactctcgggccggcccgaccgacagccaggactcctcctccgagccggacgcgggcgaccgcggcgccccagaagaagaaggcctcgagggccaggcccgggtaccgcccgcgttcccggaaccgccgggaaccaagcggaggcaccccggggccgaagttgtccccgcggacgacgccaccaagcgcccgaagacgggcgtgcccgccgcccccacgcgagccgagtcgccccccctctccgcgagatacggacccgaggcggcggagggtggtggggacggcggccgctacgcgtgctactttcgcgacctccagaccggcgacgcgagccccagccccctctccgccttccggggtccccaaagacccccatacggctttgggttgccctgacggcaacgggtggtggccgaacgcctcaccgcgcccgggcacgcggggtgcgttgtgttaaaaaaataaataaatggggtagtgtgtcccccccccctccaaccaatatggctgtcgtgtgtggttccgggttgcgcctccgtcctttccaccccccttccccctccttttttgttttgcgtgcgcttataagagcgggcccggggcccttcgcagcttcaccgagagcgccgtcgggccccgggtgcgggatgtgtcgcggggacagccccggggtcgcgggcgggagcggcgaacactgcctcggaggggatgatggggacgacgggcgcccccgcctcgcctgcgtgggtgccatcgctcgggggttcgcgcatctctggctccaggccgccacgctgggcttcgtggggtctgtcgttctgtcgcgcggcccgtatgcggacgccatgtcgggggcgttcgtgatcgggagcaccggcctggggttcctccgcgccccccccgcgttcgcccggccgccgacgcgtgtgtgcgcgtggctgaggctggtcggcgggggagcggccgtggccctgtggagcctcggggaggccggcgcgcctccgggggttccgggcccggcgacccagtgcctggcgctcggggccgcctacgcggcgctgctggtgctggccgacgacgtccatccccttttcctcctcgccccgcggcccctgtttgtcggcaccctgggggttgtcgtcggcgggctgacgataggcggcagtgcgcgctactggtggatcgacccccgcgccgccgcggccctgacggcggcggtggtggcgggcctcgggacaaccgccgccggggacagcttttccaaggcctgtccccgccaccgccgcttttgcgtcgtctccgcggtcgagtctcccccgccccgatacgccccggaggacgccgagcggccaacagaccacggacccctgttaccgtcgacgcaccaccagcgatctccgcgggtctgcggcgacggggccgcacggcccgaaaacatctgggttcccgtggtgacctttgcgggcgcgctcgcgctggccgcctgcgccgcgcgagggtctgacgcggctccgtcaggcccggtcctgccgctgtggccccaggtgtttgtcgggggccacgcggcggcgggcctgacggagctgtgtcagaccctcgcgccccgggacctcacggacccgctgctgtttgcgtacgtcggattccaggtcgtgaaccacgggctgatgtttgtggtccccgacatcgccgtatacgcgatgctggggggcgccgtgtggatctcgctgacgcaggtgcttgggctccggcgccgccttcacaaggacccagacgccgggccctgggcggccgcgaccctgcggggcctctttttctccgtctacgcattggggtttgcggcgggggtgctggtgcggccgcggatggcggcgagccggcggtcggggtgatcgccatttcaaataaaaggcacgagttccccgaataccaccggcgtgtgatgatttcgccctaccgctccgatccccggggggaggggggaaggaaatgggggcgggggtgccgtggacgggtataaaggccaggggggcaggcgggcccatcactgttagggtgttaggttgggaggtggcacaaaaagcgacactcccgtgttgtagttgtccgcgggaggcggtggtttccggcaaccctcctcgctgcgccgggcgcgcccaccggtccttcgcgggggccggggctcttctggtcatggcccttggacgggtgggcctagccgtgggcctgtggggcctgctgtgggtgggtgtggtcgtggtgctggccaatgcctcccccggacgcacgataacggtgggcccgcgggggaacgcgagcaatgccgccccctccgcgtccccgcggaacgcatccgccccccgaaccacacccacgcccccccaaccccgcaaggcgacgaaaagtaaggcctccaccgccaaaccggccccgccccccaagaccgggcccccgaagacatcctcggagcccgtgcgatgcaaccgccacgacccgctggcccggtacggctcgcgggtgcaaatccgatgccggtttcccaactccacccgcacggagttccgcctccagatctggcgttatgccacggcgacggacgccgagatcggaacggcgcctagcttagaggaggtgatggtaaacgtgtcggccccgcccgggggccaactggtgtatgacagcgcccccaaccgaacggacccgcacgtgatctgggcggagggcgccggcccgggcgccagcccgcggctgtactcggtcgtcgggccgctgggtcggcagcggctcatcatcgaagagctgaccctggagacccagggcatgtactactgggtgtggggccggacggaccgcccgtccgcgtacgggacctgggtgcgcgttcgcgtgttccgccctccgtcgctgaccatccacccccacgcggtgctggagggccagccgtttaaggcgacgtgcacggccgccacctactacccgggcaaccgcgcggagttcgtctggttcgaggacggtcgccgggtgttcgatccggcccagatacacacgcagacgcaggagaaccccgacggcttttccaccgtctccaccgtgacctccgcggccgtcggcggccagggccccccgcgcaccttcacctgccagctgacgtggcaccgcgactccgtgtcgttctctcggcgcaacgccagcggcacggcatcggtgctgccgcggccaaccatcaccatggagtttacgggcgaccatgcggtctgcacggccggctgtgtgcccgagggggtgacgtttgcctggttcctgggggacgactcctcgccggcggagaaggtggccgtcgcgtcccagacatcgtgcgggcgccccggcaccgccacgatccgctccaccctgccggtctcgtacgagcagaccgagtacatctgccggctggcgggatacccggacggaattccggtcctagagcaccacggcagccaccagcccccgccgcgggaccccaccgagcggcaggtgatccgggcggtggagggggcggggatcggagtggctgtccttgtcgcggtggttctggccgggaccgcggtagtgtacctcacccacgcctcctcggtgcgctatcgtcggctgcggtaactccggggccgggcccggccgccggttgtcttcttttccaccccttccgtcccccgtacccaccacaccccaccccacccccccgccgtcccccgggcgttataagccgccgcactcgcttttcccaccggaaaatcctcggcccgatccgaacggcgcacgccgcgtgggctccaaacgcctccggaagagagcgccccgccccgatattcaagcccgcggtggtgctatggctttccgtgcttcgggacccgcctaccagcccctcgcccccgcggcctccccggcgcgggctcgtgttccggccgtggcctggatcggcgtcggagcgatcgtcggggcctttgcgctcgtcgccgcgttggttctcgtaccccctcggtcctcgtggggactctcgccgtgcgacagcggctggcaggaattcaacgcgggatgcgtcgcgtgggaccccacccccgtcgagcacgagcaggcggtcggcggctgcagcgcgccggccacccttatcccccgtgcggccgccaagcacctggccgctctgacacgcgtccaggcggagagatcgtcgggttactggtgggtgaacggagacggcatccggacctgtctgagactcgtcgacagcgtcagtggcatcgacgagttttgcgaggagctcgcgatccgcatatgctactacccacgaagccccggcgggtttgtccgcttcgtaacttcgatacgtaacgccctggggttgccgtgaggcgcgcgtccgacggtcccgcttctcgcctctcttcttcccccaccccacccaccgaccaacgacggcgtttggccaataccctccttttttctttttctcttccccccccccccaaaaaaaacaataaacagctaattgcgtacgacaaaccatgcggaactcgctgttttttttctctgtttgttactttttattgaaacagacatacggggaaaggggccggaaaccgagacggtggggccggcggtcgcatttttttaatggctctggtgtcggccgcgtttgagcttcgtcaacagggcgctgagggcggcgacgttcgtcgggccgtcgttggccagcgcgttggtccgggggcgggcgggcatgggcgacaggcttagtcccgggtccggggcgcgtgtggcccccggaggggagaagagggcagacccgccccagtcgtacaggggattttccgcctcgatgtacggggagtccggggcgtctcccggcagggcggccccgccggcaagacgccggcgagggcagatgttttcgtatacccgaacccaggggatctcctcgtagacgcgccccccatcctcgcccaccgactcgtaaatggaatctgcgtcctcggagggggcgcggggggcgtggctttcggccggccaggcggcggcggcggtggtgtcggcggcgggggtggcgccaagcccgacgcccgcgggcatggcggcgtcatcgtcgggcagcagatacgtgttttccatctggtccggttcggcctccgcgtccggcccccaggtccgcaccgcgtcgtagaccccggcggcctcgcgctgagccgcgagcgggcgcgccgcggctgccggccgctgctcggggggcgcggggttgcggggcgggaggcgcgggggcgccccggccatatgcgtgtaatacgtggccggccggccggcgcagggctcgggaccccggtcggccgcgtcgacgtgcgggggctcggggaggtcctcgcggtggcgcctgaacctccgaggggccgcgggggtcgagtgggggcgagcccgggggagcggcgggggtgcgttgtcgcgccgggtccgttgtatcttgtcccggcagctcccgccgaccgcgccgcggccccccggtgggccggacgccgcgaggcgcaggatggactcgtagtggggcgacggggttccgctccgaagcaggtccggggccagggcggccccgaaccaggacttgatgctgagttccatccgggcccagctcggggcggtcatcgtggggaacaggggggcggcggtcctgcagaagcgctcctggctgtccaccgccgcccgtaggtactcgttgttcaggctgtcggaggcccagacgacatacccggtaagcgtcgcgttaattatatactgggcgtggtggtggactatggatagaacctcgacggtcgagacgatggcgtccacgatcccgtacgtgccgccgctgcgcttgccggtctcccacaggtgggccaggcgcgtcaggtggcccaggacgtcgctgaccgccgcccgcagggccatgcactgcatcgagcccgtggtgccgctgggcccgcggtccaggtggcgcgcaaacgtctccgcgggcgcctccagactcccgctgagcgccacgaaccggcgatcggcggggcccaggcggcgacacacgtacttgtccgccgtccacagcatccacgaggcccaatggtacaacacggagacgtaggccaggagctcgctcagccgcagtgcggtgtccgtgctcggccggctcgggtctgcggggcgcataaagaacatgtactgctggagcctgtgggccgcgtcgcgcaaccccgccaccgcggcggcgtacttggccgcggcggccccgctcttgaacggggcgcgcaccagcagcttcgggagcagggtgggccgcagcagcacgtgcaggctggggtcgcagtcgcccgccgggtcgtcggggatgtccaggccgctgggcacgaccgtctggaggtacttccagtactgcgctaggatggcgcggctcagctggccgcccgacagctccacctcgccgagcgcctgcttggcggccgacgcgtagtgccggatgtagtcgtagtgcgggtcgctggcgagcccgtctacgatcaggctctcggggacggtgttatggtgccgcgccgccagccggacgctgcgatcggcgccggtcagaaacgccggctgcaggtcgtcggcgcgctgccgcaggacgcccacggccgcgctgaggagcccctccggggtggggagcagacacccggcgaagatgcgccgctcggggacgcccgcgttggcgccgcggatgaggttggccggcgtcaggcaccgcgccagccgcagggagctcgcgccgcgcgcccggcgttgcatggcggagaccgttcggtcgggggccccgccggtcggaggtatgccgcgtcccgggatatagggttgctttttatggggaggcgcctatgggcgtggcgggccgcccagcccggtcgcgcgcctcccggacacgtgcgcccggagggcggcggtctcctcgtcgcccatgagcagtttccgaaactgcgccatgatgtccacgacgcggacccgcggccccagcacggactcgctattcaggggggcgggggggaaggccgccaggtcttcgagcaggaaggcggggtctgccgtcccgctcacgggcgcccggggcgccgaggacgcggggcgaaggtccacgtgttccgcggcggcgcgcacgtccgcccaaaatttggcgggggtggtccgcgcgtacaggggctgggtcgcgcggaggacgcacgcgtagcgcaggggggtgtacgtgcccacctcgggggccgtcgacccgccgtcaaacgcggccagggccacgcacgcgaccaccgtgtcggccaggcccagcagccgctgcaggatgagccccgtcgccagcacggcgcgcgcggccgccgcgtcgtccctgcgccggcgcgcgtccccgcaggccagggcgtatttcagggtaacggtcgccagggccgtgtgcagcgcgtacacggccgcgcccagcacggcgttcagcccgctggtggcgagcaggcggcgcgccgcggtgtcgcccagcgcctcgtgctcggccgccacgaccccggggctgcccaggggcagggcgcgaaacagcgcctcctgctccacgtccgcaaacgcggggtgggcggagtgcgggtgcaggcgcgcccccacgaccaccgagagccactggaccgtctgctccgccaggaccgccagcacgtccaggacgcgccccgcaaacgcggcctcccgcgggagcacgcatttgacggcgccggggttgaagcgggcgagcagagccccggtggcgatgtacgtcatgcgccccgcgtagcgggcggccacgcgacagtcgcgccccaggagcgcgcgcaccccgggccagtacagcagggaccccagcgaactgcgaaagaccgcggcgtcggggccggggtgggggggcgcggcccctcccgcgctgagcagcggcacggcggcggcccccacgggccgcaacgccgtgaggctcgcgaactgccgtcggagctcggccgccctgtcgtcgagctccgagccgcgcccctccgtgtgcaggcgcgtcccgcagacccacccgttgatcgccacccgcacgatggcgtccaccagaaagcccatcgcgcgggaggggctggtttttgcccgccgatccgtcaggtcgaggatcgcgtcgcccgtgacgtaccaggccagcgcctcgccctgctgcagcgtctggcggaaaaacacctttgggtcggccggggaggcaaagtgcatgacccccacgcgcgacagcccgaacgcgctatccggacacgggtagaacccggccggatgtcccagggccagggccgagcgcacggactcgtcccacgcggcgactcggggggtcaggcggtccagggggaatgccgcctgcagctccgggcccgacacgcggcccgcgagaatctcgaccgtcgcggaaggccgcgccccggcgccgtcatcgtgcgcgacggcggcggggtagtcgtcctcctcgtagttgagctcgtccaggaacagcggcgagggcaccacccgcgaaccgcccacccgccccaaaacgtcgcgtgggtccatcgggcccaggtagcctccccgcggggcccgcgtgatggcgctgtcccggcgtccgcgaacggactggctcctggccgtaacggacctggggcgcggaaaggacgcccggcgggggggcgccgccgcccgggcctcggacgcgcgtcgggacccggggtgaccgcgggcctcccggcgacggcgcgggggcggctcttcgctcgccatctcccccgcggcctcgacctcgctgtcgtcgtccacgttaaacaccgcccgcaggtaccccattaacccgactccaccgccctcgggctcgtcctccacgggcgagtcggcgcgatgcgcggacggggcatgggaccgggtggaggcgcgcctccggcgtacggcatgcccgcgcacggacatggtggccggaggcccgattttttacacacgccctccccgcagacggacgaggaaaggggtggtgcgaggggggaggcccaaacggggaggtggggggtagggggcggtcccagggagcggggggtaggaaccggcacgacgggaacagagaaaacgcgaccgctccaacaagggtgggggggtgggcctcgtccccacgcagacccgcgggcaaatgcgagaacgggacccgcgcgcctgcctttatacgcggaccccagcaccacgagccgttctgtgacgcgaatctacacgaccgcgggctcgtaggcgcgactaacgcccaacccaacggcacacaccccccaccccgcgcgtaaccccatttctttcatggtcccgtaataaacagccaacgcacgccgcgtatgatgagttgcttgccaatgtttattgctgtggttgcgaaccctctatcgcgatacagacggaggtgaggcggggcggtggtgggggggggcgcgccgcccggtcgcacatcctaccccccaaagtcgtcaatgcccatggcatcggtaaacatctgttcaaactcaaaatcgtccacgtccaaagccccatacgagacggggtcgtgggtcattcccggggagggggactccacgtcccccagcatctccaagtcgaagtcgtccagggcgtcggcgggcgtcatatccacctcctcgccgtccaggcggagttcgtctcccaggctgacgtcggtaatgggggcggtggtggacagtctgcgggggcgttgtcccgcggagagaaacgacatgcgcggcgccaccagcccggcctccgcgggagcgtcatcgtcgtccgggaggtcgagcaggccctcgattgtcgatccgtaattgtttctggtccgcccgcggctatacgcgtgctcccgcatgacggactcgccctccgaggtcgcgacgctggagtacgagtccaacttggcccggatcagcagcataaagtacccagaggagcgggcctggttgccctgcaggacgggcggggtcgtgaggggcgccccgggttcctccgccgccgcacttcgcaccagcgggaggttcaggtgctcgcgaatgtggtttagctcccgcagtcgccgggcctccacgggaactccccgcacggtgagcgatccgttgataaacatcaggggctgaaacagacacgccaactggcgccagctctccaggtcgcagcagaggccgtcgaacagatcgggccgcatcatctgctcggcgtacgcggcccataggatctcgcggctcagaaagaggtatagatgcagaaacaggacgcgcgccaggcgcgcggtctcgcggtagtacctgtccgcgatcgtggtgcgcagcatctcccgcaggtcgcggttgcggccccgcatgtgtgcctggcggtgtagctgccgaacgctggcgcgcaggtaccggtacagggccgagcaaaaatttgccaacacggtccggtagctctcctcccgcgcccgcagctcaccgcggaaaaactgcgccatggcctcgtagtacgaaggcagctcgtcgcgggtggcgggcagggtggggaacgccacgtcgccgtgggcgcgaatgtcgatcggggagcgctcggggacgtgcgcatccccccagtcgatcacgtcgctgggcagcgtcgacagaaacttgcactcccggtacatgtcggcgttggtcgggaacccagagaacaggtcctcgttccaggtatctagcatggtacacagcgcgggacccgcgctgaagcccagatcgtcgaggagacggttaaacagggccgcgggggggacgggcatgggcggcgagggcatcagctgggcctgactcagccgaccggtggcgtacagcggaggggcggctggggtgttcttgggacccccggctggcctggggggcggtggcgaaaccccgtccgcgtccgcaaacagatcgtcgaccaacaggtccatgggggcggttgggtccgggaataacgatctcgagaggcgaatgagacgtgcccgagcgcccggcggcggagagggggggagggatccgggacccgcgacagaaaaaggccggggccctcgcgaagggaatcgccgggggtgccgtgcgtccccgaggactgacatctcgcgtccaccaccccgcatttaagtatcaccccagtgccgccccaaacctcgtgacttccccaccgctccgggcggcccgtcccccgcgctcggaagggaggcgtgtccttcctcccgcccctcccgcccctcccgcccctcccgcccctcccgcccctcccgcccctcccgcccctcccgcccctcccgcccctcccgcccctcccgcccctcccgcccctcccgcccctcgccacaaacgcgtgctgacagcgaagtggttaaatcgaccgtgatgctttattgtctgtcgtctgaacgcggtcggggtcgctactcgagggggcggcggggacgggaagccgagcgggcgggggcccgtgcggtcgcggcggcacgccccgcggggcggccccgggcggccgcggtcgcgtcgacgtcctgcgccgcgtcgggattcaccaactcgttcgcgcgctgcaggaggttcttgccctcgcagaccgtcacgcgaatggtggtgaggtcgaggagctcgttgaggtcttcgtcggtgtgcggccgcgacatgtcccacagctgtaccgccgccagccgggcgtgcgtggccgccaggcgcccgaccgcggcgcagaagacgcgcttgttgaacccggccacccggggggtccacggcgccgtggggctcggtggggcggtgctgaagtgcagcttcttggccagtccctgggcgggtgtcttggttcttcccgaggccgtgggagcgggggcgtctaggagcacggcggagtcggcctgggcgggtcgcctgccgcgggcggggtcggtcgccggggtcgcggaggccttaggcgccccgcgcgtcattttgggggtccgcgcgggaggggcgtgcgagcgcccgccggcgcccacggggcccccggggggtggaggagcgcgcgcggggccggggccgtgagagcccgcgacggacgccgaacgacgcggtcgcgcggtatcccgggactcgtcgtcgtccgaagacgagtcccggtagagggcatacccagcctcgtcataatggagaaagcgaacctcgcccctcgggcgcgcgcgcatcgggccagcgccgcggcggaagtcgtcgcgcggactctctgggtccgccggggagaccgggccatagtacagctcctcgtgggtcccgcgcggcgcttcccgcggacacgacttgacggagcggcgagaggtcatggtctatcggagacaccggggacgcccgtgcggatcacagggaaggcgtcggcgaaggaggcagagagcgtcggaaggcggcgagggagggaaagagggagaccggcggggtacgggagagcagcgagggcctgcgtaacccacgggggccgcgggagtggctccctgcgggttgcgggggagagtttataggaagtggatataaccgcaggcgacgggactaaccaatccccgggggggcaacggacagacacgccccgaacaggcccgacttccgcgaggaagcaaaggccgggggccgcccaacgacacgcccaccccttcccaacagggcgggctcaggctgacccggcggccagtgcccgctgacatatctgatacacgtgcgcgatcatacatacgcccatcgaggtcatgcctagataaaagggcaccaggacccccgggacggacaccacaccggcgctgtcgccccggcattgcgcgtccccgataacgccgcgtgcgcctgccgcgttcggcggctccccgggcacgcccgcgacgagcgcgacgaacaacagcaccacccagcggcccagtcttgcgggtttccccgtcatcgcggcgatgagtcagtgggggcccagggcgatccttgtccagacggacagcaccaaccggaatgccgatggggactggcaagcggccgtagctattcgcgggggcggagtcgttcaactgaacatggtcaacaaacgcgccgtggattttaccccggcagaatgcggggactccgaatgggccgtgggccgcgtctctctgggcctgcgaatggcaatgccgcgggacttctgcgcgattattcacgcccccgcggtatccggccccgggccccacgtgatgctcggtctcgtcgactcgggctaccgcggaaccgtcctggccgtggtcgtagccccgaacgggacgcgcgggtttgcccccggggccctccgggtcgacgtgacgtttctggacatccgggccacccccccgaccctcaccgagccgagctccctgcaccggtttccgcagttggcgccgtccccgctggcagggttacgagaagatccttggttggacggggcgctcgcgaccgccgggggggcggtggccctgccggccagacggcgcgggggatcgctggtctacgcgggcgagctaacgcaggtgaccaccgagcacggcgactgcgtgcacgaggcgcccgcctttctgccaaagcgcgaggaggacgcaggctttgacattctcatccaccgagccgtgaccgtcccggccaacggcgccacggtcatacagccgtccctccgcgtattgcgcgcggccgacggaccagaggcctgctatgtgctggggcggtcgtcgctcaatgccaggggcctcctggtcatgcctacgcgctggccctccgggcacgcctgtgcgtttgttgtatgtaacctgaccggagtcccggtgaccctacaagccgggtccaaggtcgcccagctgctcgtcgcggggacccacgccctcccctggatcccccccgacaacatccacgaggacggcgcattccgggcctaccccagaggggttccggacgcgaccgccaccccccgagacccgccgattttggtgtttacgaacgagtttgacgcggacgcccccccaagcaagcggggggccggggggtttggctccactggcatctagaccgcgcctcgcgtcgggccagatggggccccggtcaataaagagctctgtttcgcatatgccctggtgttggcggttttttttgttgtctgtctgcccggcgctcggttgtccgttctgtcgtcgctatcacatacgcacaaacacacgggtagagtggaaccgaaaccggtcgacgtttattcaccacacagaaacacaagctaagcgagaaggaggggggcctcggtcgacgaggcctggcgtttgggggcggacgtgcgatgacgtgggtccggtgtagggtccgcggggggcacgggcccggggcgaacgggggatctgtcgccggcgtgggtgactgggaccgacgcaacctccggggcttgtgccctcgtaggcccggggggggcctcggtcgctccaagccccgcggtgcgggtccctccggccagagccgaggtggagagaccaagggcccgctccgcgatcgccacgtcctccatgaccacgtcgctctcggccatgctccgaatggcctgggagacgagcacgtccgccgacttgtccgcggcccccaccgacatgtacatctgcaggatggtggccatgcacgtgtccgccaggcggcgcatcttgtcccgatgcgccgcaacggccccgtcgatggtggagccctcgagtcccgggtggtggcgcgccagcctctcgaggttgaccatgcaggcgtggtatgtgcgggccagggcgcgcgccttcacgaggcgccgggtgtcgtccagcgactctagggcgtcgtcgagcgtgatgggggcgggcaaaagcgcattgaccaccgccagggcctcctgcagccgcggctccgcctccgagggcggagccgcggcccgaatcatctcatattgttgttcctcggggcgcgttccccaaccgcacagcaccccgagcagggacgccatcccggaacacgcgcgcggctctgcgccggctttcccccaccccaccccctccgggttcgcaggggcgatggggacggaagactgcgatcacgaagggcggtcggttgcggctcccgtggaggttacggcgctgtatgcgaccgacgggtgcgttatcacctcctcgctcgccctcctcacaaactgcctgctgggggccgagccgttgtatatattcagctacgacgcgtaccggtccgatgcgcccaatggccccacgggcgcgcccaccgaacaggagaggttcgaggggagccgggcgctctaccgggatgcgggggggctaaatggcgattcatttcgggtgaccttttgtttattggggacggaagtgggcgtgacccaccacccgaaagggcgcacccggcccatgtttgtgtgccgcttcgagcgagcggacgacgtcgccgtgctccaagacgccctgggccgcgggaccccattgctcccggcccacgtcacagcaactctggacttggaggcgacgtttgcgctccacgctaacatcatcatggctctcaccgtggccatcgtccacaacgcccccgcccgcatcggcagcggcagcaccgcccccctgtatgagcccggcgaatcgatgcgctcggtcgtcgggcgcatgtccctggggcagcgcggcctcaccacgctgttcgtgcaccacgaggcgcgcgtgctggcggcgtaccgccgggcgtattatgggagcgcccaaagccccttttggtttctgagcaaattcggcccggacgaaaagagcctggtgctggccgctaggtactacctactccaggctccgcgcttggggggcgccggagccacgtacgatctgcaggccgtgaaagacatctgcgcgacctacgcaatcccccacgacccacgccccgacaccctcagtgccgcgtccttgacctcgttcgccgccatcactcggttctgttgcacgagccagtactcccgcggggccgcggccgctgggtttccgctgtatgtggagcgccgcatcgccgccgacgtacgcgagaccggcgcgctggagaagttcatcgcccacgatcgcagctgcctgcgcgtgtccgaccgggaattcattacgtacatctacctggcccactttgagtgcttcagccccccgcgcctggccacgcatctccgggccgtgaccacccacgaccccagccccgcggccagcacggagcagccctcgcccctgggtcgggaggcggtggaacagttcttccggcacgtgcgcgcccagctgaacatccgcgagtacgtaaagcaaaacgtcacccccagggaaaccgccctggcgggagacgcggccgccgcctacctgcgcgcgcgcacgtatgccccggcggccctcacgcccgcccccgcgtactgcggggtcgcagactcgtccaccaaaatgatgggacgtctggcggaagcagaaaggctcctagtcccccacggctggcccgcgttcgcaccaacaacccccggggacgacgcggggggcggcactgccgccccccagacctgcggaatcgtcaagcgcctcctcaagctggccgccacggagcagcagggcacgacgcccccggcgatcgcggctctcatgcaggacgcgtcggtccaaacccccctgcccgtgtacaggattaccatgtccccgaccggccaggcgtttgccgcggcggcgcgggacgactgggcccgcgtgacgcgggacgcgcgcccgccggaagcgaccgtggtcgcggacgcggcggcggcgcccgagcccggcgcgctcggccggcggctcacgcgccgcatttgcgcccggggccccgcgctccccccgggcggcctggccgtcgggggccagatgtacgtgaaccgcaacgagatcttcaacgccgcgctggccgttacgaacatcatcctggatctggacatcgccctgaaggagcccgtcccctttccccggctccacgaggccctgggtcactttaggcgcggggcgctggcggcggttcagctgttgtttcccgcggcccgcgtagaccccgacgcctatccctgttattttttcaaaagcgcctgtcggccccgcgcgccgcccgtctgtgcgggcgacgggccctcggccggtggcgacgacggcgacggggactggttccccgacgccggtggtcccggcgacgaggagtgggaggaggacacggaccccatggacacgacccacggccccctcccggacgacgaggccgcgtacctcgacctgctacacgaacagataccagcggcgacgcccagcgaaccggactccgtcgtgtgttcctgcgccgacaagatcgggctgcgcgtgtgcctaccggtccccgccccgtacgttgtgcacggctccctgacgatgcgtggggtggcgagggtgatccagcaggcggtgctgttggaccgcgacttcgtggaggccgtagggagccacgtaaagaactttttgctgatcgatacgggcgtgtacgcccacggccacagcctgcgcttgccgtatttcgccaagatcggccccgacggctccgcgtgcggccggttattgcccgtcttcgtgatcccccccgcgtgcgaggacgttccggcgttcgtcgccgcgcacgccgacccgcggcgcttccactttcacgccccgcccatgttttccgcggccccgcgggagatccgcgtcctccacagcctgggcggggactatgtcagctttttcgagaagaaggcgtcgcgcaacgccctggagcactttgggcgacgcgagaccctgacggaggttctgggccgctacgatgtgcggcccgacgccggggagaccgtggaggggttcgcgtcagaactgctggggcgaatagtcgcgtgcatcgaggctcactttcccgagcacgcgcgggaatatcaggccgtgtccgttcgccgggccgtcattaaggacgactgggtcctgctgcagctgatccccggccgcggcgccctgaaccaaagcctctcgtgtctgcgcttcaagcacggcagggcaagtcgcgcgacggcccggacctttctcgcgctgagcgtcgggaccaacaaccgcctatgcgcgtccctgtgtcagcagtgctttgccactaaatgcgataacaaccgcctgcacacgctgtttaccgtcgatgcgggcacgccatgctcgcggtccgctccctccagcacctcacgaccgtcatcttcataacggcctacggcctcgtgctcgcgtggtacatcgtctttggtgccagtccgctccaccgatgtatttacgcggtgcgccccgccggggcgcacaacgataccgccctcgtgtggatgaagataaaccagacgctgttgtttctgggcccgccgaccgccccccccggcggggcatggaccccccacgcccgcgtctgctacgccaatatcatcgaaggtcgggccgtgtccctcccggccatccccggcgccatgagccgccgggtcatgaacgtgcacgaggccgtaaactgcttggaggccctctgggacacccagatgcgcctggtggtcgtcggttggtttctgtatctagcgttcgtcgcccttcaccaacgacgatgcatgttcggcgtcgtgagtcccgcgcacagcatggtggccccggcgacctatcttttgaactacgccggccgcatagtgtcgagcgtgttcttgcaatacccctacacgaaaatcacccgcctcctctgcgagctatccgttcaacgccagaccctggtgcagctgttcgaggcggatccggtcaccttcttgtaccaccgcccggccgttggcgtcatcgtgggctgcgagctgctgctccgcttcgtggccctcggtctcatcgtcggcaccgctctcatctcccggggcgcctgcgcgatcacacaccccctgtttctaacaatcaccacctggtgtttcgtgtccatcatcgccctgacggagctgtatttcatcctgcggcggggctcggcccccaaaaacgcggaaccagcggcccccagggggcgctccaaagggtggtcgggcgtctgcgggcgctgctgttccatcatcctctccggtatcgccgtgcgcctgtgctatatcgccgtcgtggccggggtggtgctcgtggcgcttcgctacgaacaggagattcagcggcgcctgtttgatctgtgacgtaacgcctcttccgttggaagaggcggacccagtcgcccatgcaaattaaatacacgacccgcctcgggcctacgcaccctcgcacgtcgcatgcaaattaaaatcgtgcacagagccgatccggcctcgggtctgcttgcccctcccccggcccagcacaggcaggctcgtccgacttccgcatacaccccaccctaccgcgtgcttccgcacccccgcctacgcgtgtacgcgaaggcggacccagacctgccgtatgctaattaaatacataaaacccaccctcggtgtccgattggtttctggggacggcgggggcgggggcggtgacgcccgacggggagggacaaggaggagtttcggaaagccggccccggtcgtgcgggtataagggcagccaccggcccactgggcgctgtgtgctgccgtgtgccgaccccggttgcgcgtcggtgccgctcctcgattcggacccggccactctcttccgacacgcgccccctcggaggacacccgccatcccagccccggcgacctacaacatggctaccgacattgatatgctaatcgacctaggattggacctgtccgacagcgagctcgaggaggacgctctggagcgggacgaggagggccgccgcgacgaccccgagtccgacagcagcggggagtgttcctcgtcggacgaggacatggaagacccctgcggagacggaggggcggaggccatcgacgcggcgattcccaaaggtcccccggcccgccccgaggacgccggcacccccgaagcctcgacgcctcgcccggcagcgcggcggggagccgacgatccgccacccgcgaccaccggcgtgtggtcgcgcctcgggaccaggcggtcggcttccccccgggaaccgcacggggggaaggtggcccgcatccaacccccgtcgaccaaggcaccgcatccccgaggcgggcggcgaggtcgccgccggggccggggtcgatacggccccggcggcgccgactccacaccaaacccccgccggcgcgtctccagaaacgcccacaaccaagggggtcgccaccccgcgtcggcgcggacggacggccccggcgccacccacggcgaggcgcggcgcggaggggagcagctcgacgtctccgggggcccgcggccacgaggcacgcgccaggccccccctccgctgatggcgctgtccctgacccccccgcacgcggacggccgcgccccggtcccggagcgaaaggcgccctctgccgacaccatcgaccccgccgttcgggcggttctgcgatccatatccgagcgcgcggcggtcgagcgcatcagcgaaagctttggacgcagtgccctggtcatgcaagacccctttggcgggatgccgtttcccgccgcgaacagcccctgggctcccgtgctggccacccaagcgggggggtttgacgccgagacccgtcgggtttcctgggaaaccctggtcgctcacggcccgagcctctaccgcacattcgcagccaacccgcgggccgcgtcgacagccaaggccatgcgcgactgcgtgctgcgccaggaaaatctcatcgaggccctggcgtccgcggatgagacgctggcgtggtgcaagatgtgcattcaccacaatctgccgctccgcccccaggaccctatcatcggaacggcggccgccgtgctggaaaacctcgccacgcgcctgcgcccctttctgcagtgctacctgaaggcccgaggcctgtgcgggctggacgacctgtgctcgcggcgacgcctgtcggacattaaggatattgcctcctttgtgttggtcatcctggcccgcctcgccaaccgcgtcgagcgcggcgtgtcggagatcgactacacgaccgtgggggttggggccggcgagacgatgcacttttacatcccgggggcctgcatggcgggtctcattgaaatactggacacgcaccgccaggagtgttccagtcgcgtgtgcgagctgacggccagtcacactatcgcccccttatatgtgcacggcaaatacttctactgcaactccctattttaggcaagaataaacatattgacgtcaacccaagtggttccgtgtgatgttcttggcgcgcgcggcgggtggggcggagactccggggcgatgccggcgtgcgcgtgggaggagggcgatgacccaccggataaatgtggggccccggcccggcccgcttcatagcgcgtccaggaactcacggcagacgcgtattcaccgacccccccctcgcaacatgacaacgacgcccctctcgaacctgtttttacgggccccggacatcacccacgtcgcccccccgtactgtctgaatgccacgtggcaggccgaaaacgccctgcacacgaccaaaacggaccccgcgtgcctggccgcgcggagttatttagtccgcgcctcctgctcgaccagcggccccatccactgttttttctttgcggtgtacaaggactcgcagcactcccttccgctggttaccgagctccgcaacttcgcggacctggtcaaccacccgcccgtcttgcgcgaactagaggataagcgtggggggcggctgcggtgcacgggcccattcagctgcggaaccatcaaggacgtctccggtgcatcccccgcgggggaatacacgataaacggtatcgtgtaccactgtcactgtcggtatccgttctccaaaacctgctggctcggggcatccgcggccctacaacaccttcgctctataagctcaagcggcacggccgctcgcgcggcagaacagcgacgccacaaaatcaaaatcaaaatcaaggtataacccacccccttccctccgagtccgtatgcaacctcattaataaagagtgagaaccaaccaaaacagacgcggtgtgagtttgtgggttataggaacccggtaaataccacgcgacgaaccagcatgtgtgttaacgcaacttttattcgttgtatcgcgggaggggggaagcttaccgccaaaggaaggccaagatgataacgacgaccaccgcgaccaccccaaaaaccgcatgacgacacgtcccgccacaccaccctggggcttggggcgtgtcggagctcgacgcacagcgggccgcgcgttgggcccggtacagctctcgcgaattgacaagcgggggtcgccacgtgcgcgagctttgcacgcggggttggtcggccggccccacggacccgcccggtggctcggtcggacatgcggccatgaccatggcgtaggtgggggggcgatccgaggtcgcctctgcgtaagtagggaggcccgacgggaggtcgcctcccacgccagggtgggccccaatcatagtttccggtagaaacaggggggtctccacaaacaacccccctgggccaaagctccggcgccgcgcccgtcgttcggcgcggcgcctggcgcgccgagcggcccgccaggcggcgcggcgcgagcggccacgctcacacacctcgccgtcaccggaagaagccggtgaaacaagcccaaccggcgacgtccctgcagagtacggtggaggcgagtccgtgggggtgtcgatatcaataacgacaaactggcccgcgctcgcgccggccacactctcgtatgggggcggggcgtcaatcacgctatcatctccgtcatccctgcatgcgtgggcatgcccagcccccaacgccatggtggggattcgcggctcagaagcctgcatgtcgtgtggtcggtcgtagtccaacgtgcctcccccacccaccacacagccggtccccacgccgaccactagaccgcagacgtcgcccaaccgaggtccccgtgcacagaccgcgccttttatagccccaggggttgctaattaacgcacgcatgcagacgcaatttattttgctcccccgcgtcctcccctcccctgcgcacacgtgataggtcttgggaacccgaggggcgacgcggggaaagcgcgcccccgcccggccgccgcgcgcccccgcccggccgccgcgcgcccccgcccggccgccgcgcgcccccgcccggccgccgcgcgcccccgcccggccgccgcgcgcccccgcccggccgccgcgcgcccccgcccggccgcccgcgtcgcgccggcgccccctcccggcgcttccggggtctttccttccttccccgccgcgaccccggccccgccccaccgccccgcccggcaggggggccccggcgccgcgcagaacacacagacgaacacacggtggcgatcttttctttacttcggcggaccagcgagccccggccccggcccgcgccccgccgccacacccacggcaccccccccccgccgcccaccccggggtccacacaggagcgcgcgggcggcagaaacgcgggcgcggcggcggtcggggtgggagtggtggtgggggacacgaaaacacacccacgacactctccccccaccccgaccgccgccgcgccccaccggcgggatcgcggcgagacgcagccgggcccccccccaccacccgcccacccacctaccccgcgcccgcagcctccggcagcacgccgaccaccgccgccaccccccaaacagccaaggcgcggtggggggcgtggtggtgaacgatggggggaacacgggggggaggggtccggggcgaggcgggcgggcgaaggaagggggggtggtggcggcggcggtggaaagcggaaaaacggaggatggaagggcagaagatggggagtcccgatcctcctcctgcatcccctcgccttccattctccggccctccgcgagtcccgacgccccccccccgccgcccgacgaaggagacccaagcaccgcagccggagaggccgagcggggagtgggcggccgggcgggaggatggcggagagagagagagagagagagagagggggggggggggagagggaaagcaacgggaaagagaggcgcgcggaaaagcagcaagaggggggacggggcgagccgggcagagtgcggagcccccggagcccgcggccgcagccgagcagcgccgcgggctccggggccgggccgggccggcaacgccccgcgccggccgcggcggagagaacccctgtgtcattgtttacgtggccgcgggccagcagacgggccgcgggccagcagacgggccgcggcgccagcggcccacgcctcccgccgcattaggcccccgcgggcatccggcggccggccccacgcccttccattaaacactcccacgttgggggggggcgcgccagctgagtgctctgcggttgcgggcgccgtgcccggagatccattaagccgccggagagcccgagccccgcccgcgtgttgctgtgggcatttctgctgcgtcatccctgtctttataaaaccgggggcgcggcagcaacgaacgcaggggcccgccgccgatcgagagggactccggagaaggaaggctgctccgcgcaccggcgcgcccttctcctctcccctccctacctccccctctcttcccccttttttcccccgcctcccgtcttcttccgcgcctccgagggtccgcctctgcctcggggacccccgggcgggccggggcttggccgccgaggtgcgccccggccggaggggcccccgcacctcggcggccgccccctccggcgccgcgcgttcgcgaaaggcgcgaaaggggcccccggaggcttttttcgattcccggccgggggtcccgggtagccgcccggcgccgggcggaaggcgtcccccgcccggcggtccggcccgggcccccggcggagcgcgggggccccggggccccgggccgcgccggcggcgtttccgcgttccgtttcttctccctcccggccgccccgctcccgggcccgaccctcgccccttcccttctcctcgtcttcccccgtcccgccgcgccccttccctcttccttctctctctctgtctcgctctcctcacatttcccccccccccccgccgccgccgccctctgcccgcgtcccaccgagacgccgcgccgcgtgagccgtccgccgggggacccaggctccggggggggggggcgcctgcgtgtgtctcgtgtgagagagcgcgcccctcgaacgccgcgcgttctcgcaggtaggtttagggtcgtacaggtgagcttctgctgaggcggcgggagagggggggggggcgggcggaagagagaagagagcaggggttgggggagaactgttcttcctccccctttcaagaaacacgaggcgggggtcccagaaagggcaggcaggtcagccgcaccgcccgcgagccaacccgtatcctttttttctaggtgtttttgtttttgtttctgtttttgtttgttttgttattattttcgcggatccggcgtgttcggatccaccccccctttctccttcctcttcccttccacccacccccgtttcccccccccgtggtgtcgtccgggggcgtcgttcccagggggggcaggcgcgggtcgggcccatacgcccaccgcccccacgcgccggtcacccccccccaacaaccccaaaggcgcgtgcccagccacagccgtgggtgtggcgcccgtccccttcctctaccgcgtgggcgcgggcgggggggtggtggtagtggtggcggaaggaaacgggccgggggccggggccgctagggaaaggtaggcacgcgcgcggtgtgtcgacttgcatgccccgcaaaacgcgtcgtgtcgtgttgtgtcgtggtgggccgtgttgtggtgggccgtgtggtgtggtgtggtgttgcgaacgcgcgagccccctcgccccgatgggagtctccccgcagccagggtaaggaggggcgggcgtggcgggcaggtgtgcgggcggggtggggtgagtgcggttgcatgcctcgggtctcctcttcctgctcctcctcctttctcccagccagggtgaggaggggcgggcgtggcgggcaggtgtgcgggcggggtgggcgccggggcgggggtgggcacgggcgtaagtgcgggtgcatgcctcgggtcttctcttctccctcctccttcctcccacccgtccccgggggcagagggcgtgcatgcgttgtgattcaaccgccctcgcccccgccccactttccccccctctctatcaaagttccctggcccctggcttcgcgccggtggtgcggctgaccccccccctcctccctccccgagccaggcgccctcccactcctgcccaccacccccagggtctggccggccagacgtgcgtgctctgcacgatcgggcccccctccctgtcaacacggacacactctttttttacccgccagccagcccgcccacccaccaagacagggagccagaacgcaggccgggccccggctctgttctatcataaagaccaacaggcctcgggggtgggggcggcttctcgtgcccgccccccctcctcctcctccctttccccccccccatccccggcccccctgcgcgggggagctgcatcaaaggccaacaacaaagtgtgtcaaaagcatcacaaaactttattgtaaaatttttataaatataaagttttttttcctcaagttttcaacaaggccagaaagtccataacaaaatgctggtgtgtgttgctgttcggggccgtgtccgtccccccccactcccacccccacttcctgtctcctccccgtctttcccccccacctccccctgcccccgaggcgcctcggccggtggtccggtggggggcggcttccctttgggcagcaagccgagtgttagctccccctactccccgtggcccgcgggggcgtcgccggccggcgcgggcgcgccctgctcccgagaccacgggtggcgcgaccggaggccgtggaagtccagcgcgcccaccagggtgccctggtcaaagagcatgttgcccaccggggtcatccagaggctgttccactccgacgcggggggcgtcgggtagtcggggggcctcacgcagttgcgcgcgtgctcggggagcagggtgcggcggctccacgcgggggccgcggcccgcagcaggtccgccacgttccccgtctggtccacgaggaccacgtaggcccctatgtggcccgtctccatgtccaggacgggcaggcagtcccccgtgaccgtcttgttcacgtaaggcgccagggccacgacgctcgagacccccgcgatgggcaggtagcgcgtgaggccgggcgccgggtcgcgggccccgggctcggggccgccctccgcgtggcgcgtcttcctggcacacttcctcggcccccgcggcgcagcagcgcgggggccgagggaggtttctcgtctctccccagcgccggacgcggacgcgacgctcccaccagccccgcccgcagaggaagaggcggaggaggaggaggaggaagaggaggcggcggaggaggaagaggcggcggaggaggaagaggaggcggcggaggaggaagaggaggcggcggaggaggaagaggaggcggcggaggaggaagaggaggcggcggcggcgaccgcggcctgggacgacggagacgccgacgggggcgcggcgcccgcggacgccggggcgagcggcccgtggccgcggtcgcccgagtccgagtccggggcccggcgcggcgccgccctcttggcccccaccccctggggggcgaggggcgagcgcggggcggcggaggaagaggcggaggacgaggccgcagggcccgagtccgacccgcgcctcttccgggggcgggccgccgccccctccgcggcgtggggggcggcaccgggggtgttggtgccgcgggggaccccgggtcctccctccgcgcccggccctcccgacccgcgcgcgtcggtcgcgcctgcccggcccagactctgtgcttgggtgtcggtctgagcctgggtcatgcgcgaccggggcgcgcggtgcgcgtccaccggcacggcgggcggcgcgggcccggccgcgtccgcgctcgcagacaccacgggggcggcggcggcgcggggcggactccggacgcgcggggcgacggccgcgcgggggcgcgccgcgcgccccgacgactgtggcagacctccccccccggggcccgaggacacctgcgcggaggaggaggagaaaaaggagagcggcccggggcccgcggggcggcgcggagacggcgggggagagtcgctgatgactatggggggctcctgggccgcgcggggctgtcccgcggggggcgtcctgccctccgccgccgcggcgtcttcgcccacccgccgcgcctgcgcgcgccccccgccggccgcagggggaagagaggccactctcggcacgacggccgcgacggcagggccgcccccagacccagatcccacccccgcccgcaacggggcgccgccgctgctgctgctccgcggggcgccagggggcgccggtcgggtcgcggcgggctgggaggttccgcgggtcgcccccgcaccgccgcccccgcgccggggcgctcttcggggggcgggcgggacgtagtccactgcagagggagacagagacgggagcccccggttagtgcccgacccccgcccgacccccgcccgacccccgcccgacccccgcccgacccccgcccgacccccgcccgacccccgcccgacccccgcccgacccccgcccgacccccgcccgacccccgcccgacccccgcccgccctcaccgtcggccaggtcatcgtcctcgtcgtccgtgccgggccacgggggggtgggcgacagggcgcggaccgtgtgtccccccagcgacagggagcgcggggccgtccgctggttgcccgtccagataaagtccacggccgtgccggcccgcacggccgcctcggcctccacgcgggtccgggggtcgttcactatcgggatggtgctgaacgacccgctggcggtcacgcccactatcaggtacgccaccggggtgttgcacaggggacacgtgttgcgcaacggaatccaggtcttcatgcacgggatgcagaaggggtgcaggcagggaaaactctggcagcgcaggggcggggcgatctcgtccgtgcacacggcgcacacgtcgcccccccctcccgcttccgcttcctcctcacccacgggcccacccccgcaggatccctgcgcgtcggcgggcgtggggctgccctggcgctcggccgggggccgggccgggggcgtggccgcgtccatcaggcccgcctcgaacatctccgtgtccgtgctgcccgcctcggaggtggagtcgcggtgaaggtcgtcgtcagagattcccacctcggtctcctcctccgagtcgctgctggcgagccactgcatgtcgttgagcatcccccaggcgtgcggggcggcgggctgcttgacaaagcaacgggggggatttagagggcgcggggcgtgaggcgggacccccgcgccgtgtcccccgtgtccctccctcaccccggccccccgcccgctgctttttgttcggaagggggggagaaaggggtccgtaaccaaaggtggtctgcgtcctttggattccgacccctcgtctccccccctgtcccccgctctcgggctcctccctgcctccctcgcccccccagagggtcggggggcggcgcacggcccacgggggtcccccgaccgcttaagcgggccgggggtcggccccgtcaagcgtccccgcccccgagcccaccgcccgcgaccacccccaacccgcagccgggtggtccggggaaaagggggggcctgagacccgggggtcgccctctcaccgtgccgggggtctgccgcggcggccgctcggggccggggtccgcccgggagctcgtgccgggccggggttccatgagccggggtagggtagactcgagacggcggcccgcggtctctctcttgccgggttttagtctctgtctctccgggtctcctcctcccgccgggccgccgctccgtcgctcgcagtgccggggtgcgaatgcggcccgaccgtcacacggggctgccttatacccggcgcctatccactcccccaaaggggcggcatttacgattcccccaatagccgcgcgccccggcgggggcggagggagggaatccccccctctcggggcggccccgtccccggggaccaaccgggtgtactccaagaaccccattagcatgcgccgccccccgccgacgcagatgggagtccccccggcgccccgccggcgcggccctgagtggtgcccgcccccggggagaaattcattagcatactaggaagcccaggggaccaataggggccgatcagcccacccacccggcggcgcgcgaggctctgcgtgttctgccaagaaagtaatcagcataacccggaaccccgagggagtaattacgcggggagcgaggggccgtccgaacgtttttaattaccataagcgggaatggcggcccgttaaaagctgctaattaccgcgagcgggaacgccggcccattaaaagttgctaattaccatgcgcggggatggcggccgggaccgcctattaaaagtttctaattaccataccgggaagccggtctagaggatccccgggtaccgagctcgaattcatcgatgatcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggatccatgcagatcccccaggccccctggcccgtggtgtgggccgtgctgcagctgggctggcggcccggctggttcctggacagccccgaccggccctggaacccccccaccttcagccccgccctgctggtggtgaccgagggcgacaacgccaccttcacctgcagcttcagcaacaccagcgagagcttccacgtggtgtggcaccgggagagccccagcggccagaccgacaccctggccgccttccccgaggaccggagccagcccggccaggactgccggttccgggtgacccagctgcccaacggccgggacttccacatgagcgtggtgcgggcccggcggaacgacagcggcacctacgtgtgcggcgtgatcagcctggcccccaagatccagatcaaggagagcctgcgggccgagctgcgggtgaccgagcggcgggccgaggtgcccaccgcccaccccagccccagcccccggcccgccggccagttccagaccctggagcccaagagctgcgacaagacccacacctgccccccctgccccgcccccgagctgctgggcggccccagcgtgggccagccccgggagccccaggtgtacaccctgccccccagccgggacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagccggtggcagcagggcaacgtgttcagctgcagcgtgatgcacgaggccctgcacaaccactacacccagaagagcctgagcctgagccccggcaagtaactcgagctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccaggttatccgtgtaaccgccagtccgtgcttgcctagcgaactcacccgtcccggctggcgtgcgcagcccgggccgtgttgcgggccctcttaaggggcggcggcaggacggggactcccgccccgcctcttttcccccggggagtcaacccccggggggggtgttttttgggggggggcgcgaaggcgggcggcggcggcgggcgggcggcagggcagccccgcgcgcccccttccccgtccctcccccggagccggccgctcccccgcgggcgccgcccctccccccgcgcgccgcggggctgccttcccgcgggcgcccccgcgcggcttttttcccgcgcccgcccccgcgcggcaagacggggactagcaggctgtgccgcagaccaccacacactcccaagctccccgcccccccgaagacgccagtcgcaccaccgctcgccctcgcagaccagacagttgcaccaagcacccgcccgcccgcacacggttccccgccaccccctccctcccctccatcccgccgagctcgcggcagcccctcccccccgcgcgccacggggctgcggtcccgcggccgcctcccccgcggccgcctcccccgcgccccgccccgggggcttcccccgcccctccccccgcgcccgcggccccgagctcgcagcagcccctccctcccgcgccccgtgccttccctcccgctcctgcgggggggctcgggccacctgaccttcgtaacctgcactcaggtcagagccccagaccccccgcgggcgcgggagacgtgccgcccacccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgaataaaccacacaaggcggtacgttttcgtctgtctcgttctttatttctcacacacgcgcgcggccatcgccgcgtctgtcttaaaggcgcacagacgcccgattccttccccctctccccatctcccccctcccccgctcccggaagtttcccccccgtcactccccaaacagtccgtcgtcgtcgtcctccagctccgcgtccatgtccacgggctcgcgcctcggcggcgtggccagccccgcggcggtccccaccacctccacgccgccgcccgccgcggccagcaccgtccccgcgcggcccgcggccgacgcccagcgtatctgcgggggcgggcccgcgtccgcgtcgtcgcgcagcaccagcgggggcgcgtcgccgtcgggctcgagcagcgcccgcgcgcagaactcccgccgcggcccgcgcagctccgccgggccgccgcgcacggcgtcgcgccccagcgccacgtagacgggccgcagcggcgcgcccaggccccagcgcgcgcaggcgcggtgcgagtgcgcctcgtcctcgcagaagtccggcgcgccgggcgccatggcgtcgcccgcgcccgaggcggcggcccggccgtccagcgccgggagcacggcgcggcggtactcgcgcggggacatgggcaccagcgtgtcggggccgaagcgcgtgcgcacgcggtaccgcacgttggccccgcggcagaggcgcagcggcggcgcgtcggggtacaggcgcgcgtgcgcggcctccacgcgcgcgaagacccccggcccgaacacgcggccggaggccagcacggtgcggcgcaggtcccgcgccgccggccagcgcacggcgcactgcacggcgggcagcacctcgcaggccaggtaggcgtgctgccgcgagaccacgggcccgtcggcgggccagtccgcggcgcgcacggcgttgacgacgatgaggcggcggtcgcaggcgccggccagcagccccaggaactccacggcgccggcgaaggccaggtcccgcgtggacagcagcagcacgccctgcgcgcccagcgccgagacgtcgggggcgccggtccagttgcccgcccaggcggccgtggcgggcccgcagagccggttgcccagggccgccagcaggcaggacagcccgccgcgctcggcggaccactccggggggggcccgcccccggcgcggcccgcggccaggtcctcgcccggcagcggcgagtagaggatcaccacgcgcacgtcctccgggtcgggcacctggcgcatccaggccgccgcgcggcgcagcgggcccgaggcgcgcagcgggccgaaggcggcgggcgcgccgccggggggcggggcggcgcagcgcgcggccagcgaggccagcgcgcgcgggtcgaacatgagggccgggcgccacggcgcggggaagagcgggtggtccgtgagctcggccacggcccgcggggcgcagtaggcctccagggcggcggccgagggcgccggcgtgtggctgggccccggcggctggcggcgccagccgccctgcgggtcggggccctcggcgggccggcgggtcagcgccgcggggcgcggcggccgcggcggcggcgtcggcggggcggggggcgcggcccccgcgggaggggcggccgcggggcggggggcgtccgcgcggctcttcttcggggggcgcggggcgccgcccggcggcgccctggccggggcggggctcttgcgcttgcgcgcctcccgcggcgcggaggcgggcgcggcgagcgagtcggccgcggcgacggtgtcggccagcagggggcgcaggctctggttctggaagagcaggtccgcggcggcggcggcggcggagctcagcaggcgcgggctccgcggcagcgccgggcccagggccccggcgaccaggctcacggcgcgcacggcggccacggcggcctcgctgccgccggccacgcgcaggtccccgcgcaggcgcatcagcaccagcgcgtcgcgcacgaaccgcagctcgcgcagccaggcgcgcaggcggggcgcgtcggcgtgcggcggggcggccgcgcccgcgggccccgggcgcgggggcgcggcgggccgggctccggccagccccggcacggccgccaggtcgccgtcgaagccctccgccagcgcctccaggatcccgcggcaggcggccaggcactccacggccacgcggcccgcctccgcgcgccggccgccgccaccaccgccggcgccgtcgtcgtcgtcgtcgtcgtcggccccggccggcgcggaggcgggcgcggcgctcaggcgccccagggcggcgagcacccccgcggcgccgtagccggcgggcaccgcgcgctcgtcggccggcgacgccgccgccgacggcaacggggcggcggcggcggcgggcttcccgcgggcgtcgtcgccgtcgtggcggttggcgtcgccgccgtcgtcgggggttcgcgccccggtcagcgccgcgttctcgcgcgccagcaggggcgcgtaggcgcggcgcaggctggtcagcaggaagcccttctgcgcgcggtcgtagcggcggctcatggccacggcggccgccacgtgcgccaggccccagccgaagcggcccgccgccatggcgtaccccaggtggggcacggcccgcgccacgctgccggagatgaaggagctgctgttgcgcgccgcgcccgagatccggaagcaggcctggtccagcgccacgtccccgggcgccacgcgcgggttctggagccaccccatcgcctccgcgtccggcgtgtacagcagccgcgtgatcagggcgtactgctgcgccgcgtcgcccagctcgggcgcccacacgggcgccggggcgcccgaggcctcgaaccgggcccgcgcctcctccgcctcgggcgccccccagaggccggggcggctgtcgcccagcccgccgtacagcacgcgccccgggggcggggggccggccccgggccacggctccccgctgacgtacccgtcgcggtagcgcgcgtagaaggcgccggaggccgcgtcggcgtccagctcgacccgccggggccgcccggccgtgaagcggcccgtggcgtcgcggccggccaccgccgcgcgggcccggcggcgctccaggcggcccgcggtcgccgcgggggtccgggccggggcgggctcggccctgggcgggctcggccggggcgccgcccccggggccctcgcgggcacccccgcctcctcgtcgtccgcgccgagggtcccgcccgcggcgtggtctgcggcgctggcgggggcgcgggcggcgtcgtcgtcgtcgtcgtcgtcagacgaggaggcggatgcagacgaggaggaggaggcggaggaggaggcggaggacgccgacgacgaggatccggattttgatgagtcagaggcggccgagcgccggcggggggcgcgccggcggcggtggtggtggtggtggtggtgtcggcggggcgccgggggtcgcggcgacaggctggccatggggtccgggtacgccccgcggaccgcggacgtcgtctccggtccgcggacccagcggcccgcgtcgcggtcgtcgtcatcgtcgtcgtcgtcgtcgtcgtcgttctcctcgccataatcggcgcgcatggagggggtccgcggcggagaaggcgagcgggccgcttcttcttccgcgccgtcgcgctccggggggggcgacgggatcgtgcgaacggcctcgtccaccatcgaggccagcagggccagctgccgcggcgagacgacgccgtccgcggcaggctcgtcgacggcctccccggacgccggggccgcctcgtcggcatcggcatcggcggcggcgtcgtcggcctcgtcttcgttctcctccggcccaccgtgccacccgaacccgggccgcgcggcggggcgacggtccgggttcggggtgggcggcggtccgtcggctggatccggagatccggggccgccggtcgtctccgccgcggcccggagacgtcccccgtcctcgtccgccatcgcgacctcggccccgcggccctgcgtcgtcgtcgtcgtcttcttcttcttccgctgctccgccgacatcgcctccgaccggggtgtgcgggggggggtcttcttcttcttcttcaggggcggcagtgggggggggtggttggcagtctctctcccccccgtgcggtgcgtgcgtgtgcctgtgtcttttcgcctctccgcgccgatcgggtagatcctggcggccgcgtcggtagccgcgctccgtgtggacgatcgccccgtcgcctggctgatatagtcctcggggcgcgcggggcggggggaaaggaggaggacgcggaggaggagcgatcgacgccgccgcgccccggctcgccggggttccgcccccaggtggaaccgcattatgcgcggccccgccccgacgcccgcgcgtccgcgtccgtggcggcggcccgttggtcgcgccgccgccggctccgcccgcgcggcatctcattagcgcccggcgcgggcggcttccgcttccgcccgcgatgctaatgagaccctcgtcgcgggcgggctcgctcccctgcccttccgggttcgtggtaatgagatgccggccccgcgctcccgttggcccccgccggccccaaaggggccggcgaggtcgccccgttggtccgcgggcggctccgccccaaagggggcggggccgcagggtaaaagaagtgagaacgcgaagcgttcgcacttcgtcctaatagtatatatattattagggcaaagtgcgagcgctggcgccctgcccggggcccgcgtcatcccgcgggctccgccccaaagggggcggggccgcagggtaaaagaagtgagaacgcgaagcgttcgcacttcgtcctaatagtatatatattattagggcaaagtgcgagcactggcgccctgcccggggcccgcgtcatcccgcgggctccgccccgaggcgggcccggacggggggcgggccgttcctcgcgcacataaagggccggcgtcccggtcgccgccgcaccaggggcacaccggctgcgcggcggagaccgggacggcagcggcggcatcgcgaagggggccacagcgagacagagacgccggcggcgagcggggcaccgacgcacccggatcggatcggatacagagacgcgggcgcatcggttccttttcgttctgcctttccctcccccccccccccccaccctgtacgtaccgcgaggacccatccacccactgcagccttatcgcaggtacggtgacccggggggccgggccggggggacgggccggggggacgggccggggggacgggccggggggacgggccggggggacgggccggggggacgggccggggggacgggccggggggacgggccggggggccggggggccggggggccggggggacggggggacgggccggggggacgggccggggggccggggggacggggggacggggggacggggggacggggggacggggggacggggggacggggggacggggggacggggggacggggggacggggggacggggggacggggggacggggggacgggccggggggacggggggacgggccggggggacggggggacggggccccgatcccaacatccgcgctttctcgcaggccgggcgccgccttcgtggacgggacaccggtgtggtaactggcgacaaggcgttgccactatggcagacatccccccggacccgcccgcgctcaacacgacgcctgcgaatcatgctcccccatccccacccccgggttcacggaagcgcagacgccccgtcctccccagctcgtcggaatctgagggtaagcccgacacagaatcggaatcctcctcgaccgagtcgtccgaggatgaggcgggagacctacgcggcgggcgccgtcgctccccgcgggagctcggggggaggtattttttggatctgtcggcagaatcgaccacggggacggaatcggagggaacggggccgtcggacgacgatgatgatgatgcgtcagacggctggttggttgacacacccccccgcaaatccaagcgaccccgaatcaacctgcgattaacgagctcccccgaccggcgtgcgggtgtggttttccccgaggtgtggagaagcgacagacctatccgcgcggcgcaaccccaggccccggcccagtcttccggggatcgcgcagccgcaccgcggcgctctgctcgccaggcccagatgcggagcggagccgcctggacgcttgatctgcattacatacgccagtgcgtcaaccagctctttcggatcctgcgtgccgccccgaacccgcccggcagcgccaaccgcctgcgccacctggtgcgagactgctacctcatgggctactgccggacccgcctggggccgcgcacgtggggccgcctgctgcagatctcgggcggaacctgggacgtgcgcctgcgaaacgcaatccgggaggtcgaggcgcattttgaacccgccgccgagcccgtgtgcgagctgccctgtctgaacgccaggcgttacggccccgagtgtgatgttggcaatctcgagaccaacggcggctcgacgagcgatgatgagatatcggatgcgacggactcggacgataccctcgcgtcccattccgacacggagggggggccctccccggccggccgggagaacccggaatccgcgtccggcggggctatcgcggctcggctggagtgtgagtttgggacgtttgactggacgtccgaggagggctcccagccctggctgtccgcggtggtcgccgataccagctccgccgaacgctctggcctacccgccccgggcgcgtgtcgcgcaacggaagccccagaacgcgaggacgggtgccgaaaaatgcgcttccccgccgcctgcccctatccctgcggccacacatttctccggccatgagcgcgggacccccagcccggtgtgtttgccaaacgaaaaataaacgccctacaagaaagcttttgtgtctgagtgtctggtttttctgggggtggaggaaggaacgacaaaaaaaagaaacaaacgcgacaccgctcgtacgtgtaatggggcgcagtgttttttattagcatcggggggggttagaggttggtgattggatagcaaacgtgggatgacggaggccactcgtcgccaacggccagcgggggcccggggttctgggggtcatcgtcccccgtctgccaggagggctcatcgggaatctcgggtcgccccatgcacgtaaaacacgggcgctgcgtggggtgggtcgccggatgcgggcgggatgatgcggggcggggtttgttgtgaggagccacgagggaccgtagccagcgaagacagctgcgttcccggtcgccgggcaccaccacgccgtattggtattcgtatcggctaaggagattttccagggggtgattaggcgctgcggggaacggggtccacgacacggtccgctcgggcaaaaaccgatcgggcaggggccacggttcccccacccacgcgtcgttggtcttcgtggcgatgaagcgaaaccccagccgggttttttgtgcgtactcgaaaaacggcacacacaggtccgccgccccgaccacccacaggtggtatagccggtgggggccggggcgctcttgatgcaggagccgaaaacacgcaggggcatccagaatctcgatgctttccagggggtcgtcctccgcaaacaggcccgtcgtggtgtttgggggacagcgacaggagcgggttcgcacgatcggtcgggtgaatttgggcaagtccatcagaggctcggccagcctgcgaaggttcgccgggcgaaccaccaccggggttcccagaggctcggaggccaggatccggcattgccgaagcagaaaactccacagagccgggcttgcgtcagcggaagtccgcggcagggcgtttcgttggtctaggagggtaaccacacttacaacaacaacgcccatgtcggtatattaggcccgtggtccgatcttcactcactcgcctgtctgcggacctatgcacggcgggacggcgcgcggacccgggggggctgcttgctatcacacggcccgttcgcacgttcgattttttcagccttgtttggttggctaggtatcccggataatctgacgttccggatatagggggcggggggtagtggggggtgtgtcgacaaactgccgcttcttaaaacaccggggcccgtcgctcggggtgctcgttggttggcacgcgcgacgcggcaaatggcctgtcgtaagttctgtggggtctaccgtagacccgacaagagacaggaggcgtccgtcccgccggagacaaacacggccccggccttcccggcgagcaccttttatacccccgcggaggatgcgtacctggcccccgggcccccggaaaccatccacccttcccgcccaccgtcccccggcgaggctgcgcgcctgtgtcagctgcaggagatcttggcccagatgcacagcgacgaggactaccccatcgtggacgccgcgggtgcggaggaggaagacgaggccgacgatgacgccccggatgacgtggcctacccggaggactacgcggaggggcgttttctgtccatggtttcggccgcccccctgcccggagccagcggccatcctcctgttccgggccgcgcagccccccccgacgtccggacctgcgacagcggtaaggtgggggccacggggttcaccccggaagagctcgacaccatggaccgggaggcacttcgggccatcagccgcgggtgcaagcccccttcgaccctggcaaaactggtgaccgggctgggattcgcgatccacggagcgctcatcccggggtcggaggggtgtgtctttgatagcagccacccgaactaccctcatcgggtaatcgtcaaggcggggtggtacgccagcacgagccacgaggcgcggctgctgagacgcctgaaccaccccgcgatcctacccctcctggacctgcacgtcgtttctggggtcacgtgtctggtcctccccaagtatcactgcgacctgtatacctatctgagcaagcgcccgtctccgttgggccacctacagataaccgcggtctcccggcagctcttgagcgccatcgactacgtccactgcgaaggcatcatccaccgcgatattaagaccgagaacatcttcatcaacacccccgagaacatctgtctgggggactttggggcggcgtgctttgtgcgcgggtgtcgatcgagccccttccattacgggatcgcaggcaccatcgatacaaacgcccccgaggtcctggccggggatccgtacacccaggtaatcgacatctggagcgccggcctggtgatctttgagaccgccgtccacaccgcgtccttgttctcggccccgcgcgaccccgaaaggcggccgtgcgacaaccagatcgcgcgcatcatccgacaggcccaggtacacgtcgacgagtttccgacgcacgcggaatcgcgcctcaccgcgcactaccgctcgcgggcggccgggaacaatcgtccggcgtggacccgaccggcgtggacccgctactacaagatccacacagacgtcgaatatctcatatgcaaagcccttacctttgacgcggcgctccgcccaagcgccgcggagttgctgcgcctgccgctatttcaccctaagtgaccccgctccccccggggggcgtggaggggggggctggttggatgtttttgcacaaaaagacgcggccctcgggctttggtgtttttggcaccttgccgcccggcgtcatgcacgccatcgctcccaggttgcttcttctttttgttctttctggtcttccggggacacgcggcgggtcgggtgtccccggaccaattaatccccccaacagcgatgttgttttcccgggaggttcccccgtggctcaatattgttatgcctatccccggttggacgatcccgggcccttgggttccgcggacgccgggcggcaagacctgccccggcgcgtcgtccgtcacgagcccctgggccgctcgttcctcacgggggggctggttttgctggcgccgccggtacgcggatttggcgcacccaacgcaacgtatgcggcccgtgtgacgtactaccggctcacccgcgcctgccgtcagcccatcctccttcggcagtatggagggtgtcgcggcggcgagccgccgtccccaaagacgtgcgggtcgtacacgtacacgtaccagggcggcgggcctccgacccggtacgctctcgtaaatgcttccctgctggtgccgatctgggaccgcgccgcggagacattcgagtaccagatcgaactcggcggcgagctgcacgtgggtctgttgtgggtagaggtgggcggggagggccccggccccaccgcccccccacaggcggcgcgtgcggagggcggcccgtgcgtccccccggtccccgcgggccgcccgtggcgctcggtgcccccggtatggtattccgcccccaaccccgggtttcgtggcctgcgtttccgggagcgctgtctgcccccacagacgcccgccgcccccagcgacctaccacgcgtcgcttttgctccccagagcctgctggtggggattacgggccgcacgtttattcggatggcacgacccacggaagacgtcggggtcctgccgccccattgggcccccggggccctagatgacggtccgtacgcccccttcccaccccgcccgcggtttcgacgcgccctgcggacagaccccgagggggtcgaccccgacgttcgggccccccgaaccgggcggcgcctcatggccttgaccgaggacacgtcctccgattcgcctacgtccgctccggagaagacgcccctccctgtgtcggccaccgccatggcaccctcagtcgacccaagcgcggaaccgaccgcccccgcaaccactactccccccgacgagatggccacacaagccgcaacggtcgccgttacgccggaggaaacggcagtcgcctccccgcccgcgactgcatccgtggagtcgtcgccactccccgccgcggcggcggcaacgcccggggccgggcacacgaacaccagcagcgcctccgcagcgaaaacgccccccaccacaccagcccccacgacccccccgcccacgtctacccacgcgaccccccgccccacgactccggggccccaaacaacccctcccggacccgcaaccccgggtccggtgggcgcctccgccgcgcccacggccgattcccccctcaccgcctcgccccccgctaccgcgccggggccctcggccgccaacgtttcggtcgccgcgaccaccgccacgcccggaacccggggcaccgcccgtacccccccaacggacccaaagacgcacccacacggacccgcggacgctccccccggctcgccagcccccccaccccccgaacatcgcggcggacccgaggagtttgagggcgccggggacggcgaaccccccgaggacgacgacagcgccaccggcctcgccttccgaactccgaaccccaacaaaccaccccccgcgcgccccgggcccatccgccccacgctcccgccaggaattcttgggccgctcgcccccaacacgcctcgcccccccgcccaagctcccgctaaggacatgccctcgggccccacaccccaacacatccccctgttctggttcctaacggcctcccctgctctagatatcctctttatcatcagcaccaccatccacacggcggcgttcgtttgtctggtcgccttggcagcacaactttggcgcggccgggcggggcgcaggcgatacgcgcacccgagcgtgcgttacgtatgtctgccacccgagcgggattagggggtgggggtggggggcgagaaacgatgaaggacgggaaagggaacagcgaccaaatgtcacgataagaacaataaacctgtgacgtcaatcagatatgtgagtttggttgtgttttgtgggactgggggcggggggtgggaggtatcagtgggtgacagagtcttttaaaagacgtgtcccggggccctcgagacgcgcaacttttggccacacagagaaaggcccccagacgaagtcacccgggtccccgaacaaaaacaaaaaccttgaccgccgccggggggcgtgcctgttgttttggtctcaatggatcggtatgccgttcggacctgggggattgtgggaatcctcgggtgtgctgctgttggggccgcacccaccggccccgcgtccgatacaacaaacgcgaccgcacgcctccccacgcaccccccactcatccgttccgggggctttgccgtccccctcatcgtgggggggctgtgtctcatgattctggggatggcgtgtctactcgaggtcctgcgtcgcctgggtcgcgagttggcgaggtgctgcccccacgcgggccaatttgccccatgatttttcgcctttctggccttgcccccaccccatcgccccgattgtgtgtcgggtgcccggggtacagcagctatggagcggtcggtaatataactttggttgtcgccacacgccccgtgccgggcatgggttgtgcgggaaggacgaaataatccggcgatccccaagcgtaccaactgggggggggggggggaaaagaaactaaaaacacatcaagcccacaacccatcccacaatgggggttatggcggacccaccgcaccaccatactccgattcgaccacatatgcaaccaaatcacccccagaggggaggttccatttttacgaggaggaggagtataatagagtctttgtgtttaaaacccggggtcggtgtggtgttcggtcataagctgcattgcgaacgactagtcgccgtttttcgtgtgcatcgcgtatcacggcatggggcgtttgacctccggcgtcgggacggcggccctgctagttgtcgcggtgggactccgcgtcgtctgcgccaaatacgccttagcagacccctcgcttaagatggccgatcccaatcgatttcgcgggaagaaccttccggttttggaccagctgaccgacccccccggggtgaagcgtgtttaccacattcagccgagcctggaggacccgttccagccccccagcatcccgatcactgtgtactacgcagtgctggaacgtgcctgccgcagcgtgctcctacatgccccatcggaggccccccagatcgtgcgcggggcttcggacgaggcccgaaagcacacgtacaacctgaccatcgcctggtatcgcatgggagacaattgcgctatccccatcacggttatggaatacaccgagtgcccctacaacaagtcgttgggggtctgccccatccgaacgcagccccgctggagctactatgacagctttagcgccgtcagcgaggataacctgggattcctgatgcacgcccccgccttcgagaccgcgggtacgtacctgcggctagtgaagataaacgactggacggagatcacacaatttatcctggagcaccgggcccgcgcctcctgcaagtacgctctccccctgcgcatccccccggcagcgtgcctcacctcgaaggcctaccaacagggcgtgacggtcgacagcatcgggatgctaccccgctttatccccgaaaaccagcgcaccgtcgccctatacagcttaaaaatcgccgggtggcacggccccaagcccccgtacaccagcaccctgctgccgccggagctgtccgacaccaccaacgccacgcaacccgaactcgttccggaagaccccgaggactcggccctcttagaggatcccgccgggacggtgtcttcgcagatccccccaaactggcacatcccgtcgatccaggacgtcgcgccgcaccacgcccccgccgcccccagcaacccgggcctgatcatcggcgcgctggccggcagtaccctggcggtgctggtcatcggcggtattgcgttttgggtacgccgccgcgctcagatggcccccaagcgcctacgtctcccccacatccgggatgacgacgcgcccccctcgcaccagccattgttttactagaggagtttccccgctcccgtgtacctctgggcccgtgtgggagggtggctggggtatttgggtgggacttggactccgcataaagggagtctcgaaggagggaaactaggacagttcataggccgggagcgtggggcgcgcaccgctgtcccgacgattagccaccgcgcccacagccacctcgacccgtccgatcccggtatgcccggccgctcgctgcagggcctggcgatcctgggcctgtgggtctgcgccaccggcctggtcgtccgcggccccacggtcagtctggtctcagactcactcgtggatgccggggccgtggggccccagggcttcgtggaagaggacctgcgtgttttcggggagcttcattttgtgggggcccaggtcccccacacaaactactacgacggcatcatcgagctgtttcactaccccctggggaaccactgcccccgcgttgtacacgtggtcacactgaccgcatgcccccgccgccccgccgtggcgttcaccttgtgtcgctcgacgcaccacgcccacagccccgcctatccgaccctggagctgggtctggcgcggcagccgcttctgcgggttcgaacggcaacgcgcgactatgccggtctgtatgtcctgcgcgtatgggtcggcagcgcgacgaacgccagccggtttgttttgggggtggcgctctctgccaacgggacgtttgtgtataacggctcggactacggctcctgcgatccggcgcagcttcccttttcggccccgcgcctgggaccctcgagcgtatacacccccggagcctcccgacccacccctccacggacaacgacacccccgtcctccccccgagacccgacccccgcccccggggacacagggacgcccgcgcccgcgagcggcgagatagccccgcccaattccacgcgatcggccagcgaatcgagacacaggctaaccgtagcccaggtaatccagatcgccataccggcgtccatcatcgcctttgtgtttctgggcagctgtatctgcttcatccatagatgccagcgccgatacaggcgcccccgcggccagatttacaaccccgggggcgtttcctgcgcggtcaacgaggcggccatggcccgcctcggagccgagctgcgatcccacccaaacaccccccccaaaccccgacgccgttcgtcgtcgtccacgaccatgccttccctaacgtcgatagctgaggaatcggagccaggtccagtcgtgctgctgtccgtcagtcctcggccccgcagtggcccgacggccccccaagaggtctaggtccaagcgggccgttcggcaggcccgccccaccgcccccatcgtggttatttccccccccccccaataaaccgatgttatttgcctatatgcgtgtgttggatccctttgtgatcgttcgtcattccccggatggcatgggaggcgggtaatggatgggcggggcccgggggggaggaaaaagaataaagggggtagtgtcggagaggcccgccgcgcatttaaggagtcgccgccccgactctgtgtcttcgggtgacttggtgcgccgccgtcagctagtctccgatctgccccgaccgacggctcctgccacccgaacatggctcgcggggccgggttggtgttttttgttggagtttgggtcgtatcgtgcctggcggcagcacccagaacgtcctggaaacgggtaacctcgggcgaggacgtggtgttgcttccggcgcccgcggaacgcacccgggcccacaaactactgtgggccgcggaacccctggatgcctgcggtcccctgcgcccgtcgtgggtggcgctgtggcccccccgacgggtgctcgagacggtcgtggatgcggcgtgcatgcgcgccccggaaccgctcgccatagcatacagtcccccgttccccgcgggcgacgagggactgtattcggagttggcgtggcgcgatcgcgtagccgtggtcaacgagagtctggtcatctacggggccctggagacggacagcggtctgtacaccctgtccgtggtcggcctaagcgacgaggcgcgccaagtggcgtcggtggttctggtcgtggagcccgcccctgtgccgaccccgacccccgacgactacgacgaagaagacgacgcgggcgtgagcgaacgcacgccggtcagcgttccccccccaacccccccccgtcgtccccccgtcgcccccccgacgcaccctcgtgttatccccgaggtgtcccacgtgcgcggggtaacggtccatatggagaccccggaggccattctgtttgcccccggggagacgtttgggacgaacgtctccatccacgccattgcccacgacgacggtccgtacgccatggacgtcgtctggatgcggtttgacgtgccgtcctcgtgcgccgagatgcggatctacgaagcttgtctgtatcacccgcagcttccagagtgtctatctccggccgacgcgccgtgcgccgtaagttcctgggcgtaccgcctggcggtccgcagctacgccggctgttccaggactacgcccccgccgcgatgttttgccgaggctcgcatggaaccggtcccggggttggcgtggctggcctccaccgtcaatctggaattccagcacgcctccccccagcacgccggcctctacctgtgcgtggtgtacgtggacgatcatatccacgcctggggccacatgaccatcagcaccgcggcgcagtaccggaacgcggtggtggaacagcacctcccccagcgccagcccgagcccgtcgagcccacccgcccgcacgtgagagccccccatcccgcgccctccgcgcgcggcccgctgcgcctcggggcggtgctgggggcggccctgttgctggccgccctcgggctgtccgcgtgggcgtgcatgacctgctggcgcaggcgctcctggcgggcggttaaaagccgggcctcggcgacgggccccacttacattcgcgtggcggacagcgagctgtacgcggactggagttcggacagcgagggggagcgcgacgggtccctgtggcaggaccctccggagagacccgactctccctccacaaatggatccggctttgagatcttatcaccaacggctccgtctgtatacccccatagcgaggggcgtaaatctcgccgcccgctcaccacctttggttcgggaagcccgggccgtcgtcactcccaggcctcctatccgtccgtcctctggtaaggcgtcttccgacgacgcggacgtcggcgatgaactgattgccatcgcggacgcacgcggggacccgccagagaccctgccccccggcgcgggcggcgccgcgcccgcgtgccgcagaccacctcgcggcggctcccccgcggcctttcccgtggccctccacgccgtggacgccccctcccaattcgtcacctggctcgccgtgcgctggctgcggggggcggtgggtctcggggccgtcctgtgcgggattgcgttttacgtgacgtcaatcgcccgaggcgcataaaggtccggcggccagccccgccgcagctcataaaaatcgtgagtcacggcaaccgcaccttcgcctccggccctccgccagcgcccttccgcgtccgcgatgacctcccggcccgccgaccaagactcggtgcgttccagcgcgtcggtgccgctttaccccgcggcctcgcccgtcccggcagaagcctactactcggaaagcgaagacgaggccgccaacgacttcctcgtgcgcatgggccgccagcagtcggtcctaaggcgccgacggcggcgcacgcggtgcgtcgggctggttatcgcctgtctcgtcgtggccctcctatctggagggttcggggcacttttggtgtggctgctccgctaaatgacgcctcgatgtatggcgccttcttcgcccccacccctcgccgcgacccacgtccgtatgttaattgcaataaagtggttgattgtcattacggtctactaggttgtcttttttttttgggggggggggaggaaatgcagaaaagggtaagaaattctcggaatttcacccccgggggggggcaagtgcagtaacccagttcctcagtgtttgggaaatctattgaactctcccggctcctccgtgttagggaagtctcttggggaaatctattgacctctcgccccccccccccaggaggggggcagtgcagtaccccagttcctccgtgctggggaaatctctctgccgggtacgggctccagacgaaggacccatacatttccccatccgcaccccacatctggcgttctagagtcacgacgcatttgcccccgtccccgcagcaacacacaaagcgatttcaattttcacgattttattattaattacaccaaccaccctgtccccgggacgtggtcaggaccgggggtccgcacccaaacgcacgaaacaaatgctggcagtgtgccgaatataaccccgcgtaggaacacgtcgacgcgtgcgccaaacagcaccagaaggcgcatgccatcagcaggtcgtgcatatggcgatgtgtttggacgcagggcgcagccgcggcgataaaattcatggcggccgtccgccagggccacagcggcgaggactccctgttggcccgaagccattgggtatgaaccagctgcgcctcctgtccgaccctggctcccgccagcgggggcggtgggtcgtgggtgttgagagcacacaggcgggacacctcgatcaccgtccgaaaaaaggcccggtggtccgcgggcagcatctgcaggtgcgccagggcctgggcgttgagagggtacaactcggagccgggggactccgggggccggtccgcgcggtgccgcgagttggcacgctttggggcccgggtgtcggacgcgggcgcgttatggatcccgacgcggggcagaacgtacgtgcgttggcgcggcgatgaggggtccgggctgccgaggggggcgtaggggaccgggctaggcaagcccgcgggttgcgcggggttcccgtgggggtctaggctccctgggcacccgtgggggtcgtgggggtcgcgggtccctgggtatgcgcgggaccctgggttctctgggagatcgtggaactcgcggttccctgggctctcggggaacccggggctccctggggacacgtggtgccctgggaattcttgatggtcggacggcttcagatggcttcgggatcgagagggccgcacagactcgtagtagacccgaatctccacgtttccccgccgccggatcatggtcgccgccccggtgcgggggcccgtcggtcggaagcgagtgcccttcaagcgtgtccgctcctctgggctgcatgccgtcggatggggtgccttttaaggaaaggtctcggctgcccgccccaaccggggtttgggggtgggccggggaaaccccggatgccatgggggggtcacaccctaagcgccggcgcgctggttgggtgggggtagaggggagtccccggtcgacgagatcgtataagctgggtaccgagctcgaattcatcgatgatatcagatcgatccccatggtgtcccgtccacgaaggcggcgcccggcctgcgagaaagcgcggatgttgggatcggggccccgtccccccgttccccggcccgtccccccgtccccccggcccgtccccccggcccgtccccccggcccggccccccgggtcaccgtacctgcgataaggctgcagtgggtggatgggtcctcgcggtacgtacagggtgggggggggggggggagggaaaggcagaacgaaaaggaaccgatgcgcccgcgtctctgtatccgatccgatccgggtgcgtcggtgccccgctcgccgccggcgtctctgtctcgctgtggcccccttcgcgatgccgccgctgccgtcccggtctccgccgcgcagccggtgtgcccctggtgcggcggcgaccgggacgccggccctttatgtgcgcgaggaacggcccgccccccgtccgggcccgcctcggggcggagcccgcgggatgacgcgggccccgggcagggcgccagtgctcgcactttgccctaataatatatatactattaggacgaagtgcgaacgcttcgcgttctcacttcttttaccctgcggccccgccccctttggggcggagcccgcgggatgacgcgggccccgggcagggcgccagcgctcgcactttgccctaataatatatatactattaggacgaagtgcgaacgcttcgcgttctcacttcttttaccctgcggccccgccccctttggggcggagccgcccgcggaccaacggggcgacctcgccggcccctttggggccggcgggggccaacgggagcgcggggccggcatctcattaccacgaacccggaagggcaggggagcgagcccgcccgcgacgagggtctcattagcatcgcgggcggaagcggaagccgcccgcgccgggcgctaatgagatgccgcgcgggcggagccggcggcggcgcgaccaacgggccgccgccacggacgcggacgcgcgggcgtcggggcggggccgcgcataatgcggttccacctgggggcggaaccccggcgagccggggcgcggcggcgtcgatcgctcctcctccgcgtcctcctcctttccccccgccccgcgcgccccgaggactatatcagccaggcgacggggcgatcgtccacacggagcgcggctaccgacgcggccgccaggatctacccgatcggcgcggagaggcgaaaagacacaggcacacgcacgcaccgcacgggggggagagagactgccaaccacccccccccactgccgcccctgaagaagaagaagaagacccccccccgcacaccccggtcggaggcgatgtcggcggagcagcggaagaagaagaagacgacgacgacgacgcagggccgcggggccgaggtcgcgatggcggacgaggacgggggacgtctccgggccgcggcggagacgaccggcggccccggatctccggatccagccgacggaccgccgcccaccccgaacccggaccgtcgccccgccgcgcggcccgggttcgggtggcacggtgggccggaggagaacgaagacgaggccgacgacgccgccgccgatgccgatgccgacgaggcggccccggcgtccggggaggccgtcgacgagcctgccgcggacggcgtcgtctcgccgcggcagctggccctgctggcctcgatggtggacgaggccgttcgcacgatcccgtcgccccccccggagcgcgacggcgcggaagaagaagcggcccgctcgccttctccgccgcggaccccctccatgcgcgccgattatggcgaggagaacgacgacgacgacgacgacgacgatgacgacgaccgcgacgcgggccgctgggtccgcggaccggagacgacgtccgcggtccgcggggcgtacccggaccccatggccagcctgtcgccgcgacccccggcgccccgccgacaccaccaccaccaccaccaccgccgccggcgcgccccccgccggcgctcggccgcctctgactcatcaaaatccggatcctcgtcgtcggcgtcctccgcctcctcctccgcctcctcctcctcgtctgcatccgcctcctcgtctgacgacgacgacgacgacgacgccgcccgcgcccccgccagcgccgcagaccacgccgcgggcgggaccctcggcgcggacgacgaggaggcgggggtgcccgcgagggccccgggggcggcgccccggccgagcccgcccagggccgagcccgccccggcccggacccccgcggcgaccgcgggccgcctggagcgccgccgggcccgcgcggcggtggccggccgcgacgccacgggccgcttcacggccgggcggccccggcgggtcgagctggacgccgacgcggcctccggcgccttctacgcgcgctaccgcgacgggtacgtcagcggggagccgtggcccggggccggccccccgcccccggggcgcgtgctgtacggcgggctgggcgacagccgccccggcctctggggggcgcccgaggcggaggaggcgcgggcccggttcgaggcctcgggcgccccggcgcccgtgtgggcgcccgagctgggcgacgcggcgcagcagtacgccctgatcacgcggctgctgtacacgccggacgcggaggcgatggggtggctccagaacccgcgcgtggcgcccggggacgtggcgctggaccaggcctgcttccggatctcgggcgcggcgcgcaacagcagctccttcatctccggcagcgtggcgcgggccgtgccccacctggggtacgccatggcggcgggccgcttcggctggggcctggcgcacgtggcggccgccgtggccatgagccgccgctacgaccgcgcgcagaagggcttcctgctgaccagcctgcgccgcgcctacgcgcccctgctggcgcgcgagaacgcggcgctgaccggggcgcgaacccccgacgacggcggcgacgccaaccgccacgacggcgacgacgcccgcgggaagcccgccgccgccgccgccccgttgccgtcggcggcggcgtcgccggccgacgagcgcgcggtgcccgccggctacggcgccgcgggggtgctcgccgccctggggcgcctgagcgccgcgcccgcctccgcgccggccggggccgacgacgacgacgacgacgacggcgccggcggtggtggcggcggccggcgcgcggaggcgggccgcgtggccgtggagtgcctggccgcctgccgcgggatcctggaggcgctggcggagggcttcgacggcgacctggcggccgtgccggggctggccggagcccggcccgccgcgcccccgcgcccggggcccgcgggcgcggccgccccgccgcacgccgacgcgccccgcctgcgcgcctggctgcgcgagctgcggttcgtgcgcgacgcgctggtgctgatgcgcctgcgcggggacctgcgcgtggccggcggcagcgaggccgccgtggccgccgtgcgcgccgtgagcctggtcgccggggccctgggcccggcgctgccgcggagcccgcgcctgctgagctccgccgccgccgccgccgcggacctgctcttccagaaccagagcctgcgccccctgctggccgacaccgtcgccgcggccgactcgctcgccgcgcccgcctccgcgccgcgggaggcgcgcaagcgcaagagccccgccccggccagggcgccgccgggcggcgccccgcgccccccgaagaagagccgcgcggacgccccccgccccgcggccgcccctcccgcgggggccgcgccccccgccccgccgacgccgccgccgcggccgccgcgccccgcggcgctgacccgccggcccgccgagggccccgacccgcagggcggctggcgccgccagccgccggggcccagccacacgccggcgccctcggccgccgccctggaggcctactgcgccccgcgggccgtggccgagctcacggaccacccgctcttccccgcgccgtggcgcccggccctcatgttcgacccgcgcgcgctggcctcgctggccgcgcgctgcgccgccccgccccccggcggcgcgcccgccgccttcggcccgctgcgcgcctcgggcccgctgcgccgcgcggcggcctggatgcgccaggtgcccgacccggaggacgtgcgcgtggtgatcctctactcgccgctgccgggcgaggacctggccgcgggccgcgccgggggcgggccccccccggagtggtccgccgagcgcggcgggctgtcctgcctgctggcggccctgggcaaccggctctgcgggcccgccacggccgcctgggcgggcaactggaccggcgcccccgacgtctcggcgctgggcgcgcagggcgtgctgctgctgtccacgcgggacctggccttcgccggcgccgtggagttcctggggctgctggccggcgcctgcgaccgccgcctcatcgtcgtcaacgccgtgcgcgccgcggactggcccgccgacgggcccgtggtctcgcggcagcacgcctacctggcctgcgaggtgctgcccgccgtgcagtgcgccgtgcgctggccggcggcgcgggacctgcgccgcaccgtgctggcctccggccgcgtgttcgggccgggggtcttcgcgcgcgtggaggccgcgcacgcgcgcctgtaccccgacgcgccgccgctgcgcctctgccgcggggccaacgtgcggtaccgcgtgcgcacgcgcttcggccccgacacgctggtgcccatgtccccgcgcgagtaccgccgcgccgtgctcccggcgctggacggccgggccgccgcctcgggcgcgggcgacgccatggcgcccggcgcgccggacttctgcgaggacgaggcgcactcgcaccgcgcctgcgcgcgctggggcctgggcgcgccgctgcggcccgtctacgtggcgctggggcgcgacgccgtgcgcggcggcccggcggagctgcgcgggccgcggcgggagttctgcgcgcgggcgctgctcgagcccgacggcgacgcgcccccgctggtgctgcgcgacgacgcggacgcgggcccgcccccgcagatacgctgggcgtcggccgcgggccgcgcggggacggtgctggccgcggcgggcggcggcgtggaggtggtggggaccgccgcggggctggccacgccgccgaggcgcgagcccgtggacatggacgcggagctggaggacgacgacgacggactgtttggggagtgacgggggggaaacttccgggagcgggggaggggggagatggggagagggggaaggaatcgggcgtctgtgcgcctttaagacagacgcggcgatggccgcgcgcgtgtgtgagaaataaagaacgagacagacgaaaacgtaccgccttgtgtggtttattcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggtgggcggcacgtctcccgcgcccgcggggggtctggggctctgacctgagtgcaggttacgaaggtcaggtggcccgagcccccccgcaggagcgggagggaaggcacggggcgcgggagggaggggctgctgcgagctcggggccgcgggcgcggggggaggggcgggggaagcccccggggcggggcgcgggggaggcggccgcgggggaggcggccgcgggaccgcagccccgtggcgcgcgggggggaggggctgccgcgagctcggcgggatggaggggagggagggggtggcggggaaccgtgtgcgggcgggcgggtgcttggtgcaactgtctggtctgcgagggcgagcggtggtgcgactggcgtcttcgggggggcggggagcttgggagtgtgtggtggtctgcggcacagcctgctagtccccgtcttgccgcgcgggggcgggcgcgggaaaaaagccgcgcgggggcgcccgcgggaaggcagccccgcggcgcgcggggggaggggcggcgcccgcgggggagcggccggctccgggggagggacggggaagggggcgcgcggggctgccctgccgcccgcccgccgccgccgcccgccttcgcgcccccccccaaaaaacaccccccccgggggttgactccccgggggaaaagaggcggggcggg

SEQ ID NO: 22 - DNA, 157979 bp, synthetic construct
  source 1..157979: mol_type = other DNA
agtccccgtcttgccgcgcgggggcgggcgcgggaaaaaagccgcgcgggggcgcccgcgggaaggcagccccgcggcgcgcggggggaggggcggcgcccgcgggggagcggccggctccgggggagggacggggaagggggcgcgcggggctgccctgccgcccgcccgccgccgccgcccgccttcgcgcccccccccaaaaaacaccccccccgggggttgactccccgggggaaaagaggcggggcgggagtccccgtcctgccgccgccccttaagagggcccgcaacacggcccgggctgcgcacgccagccgggacgggtgagttcgctaggcaagcacggactggcggttacacggataacctggttctttccgcctcagaagccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagcatttaggtgacactatagaatagggccctctagctcgagttagcactcgccccggttgaagctcttggtcacggggctgctcaggccctggtgggtcacctcgcaggcgtacaccttgtgcttctcgtagtcggccttgctcagggtcagggtgctgctcaggctgtaggtgctgtccttgctgtcctgctcggtcacgctctcctggctgttgccgctctgcagggcgttgtccaccttccactgcaccttggcctcccgggggtagaagttgttcagcaggcacaccacgctggcggtgccgctcttcagctgctcgtcgctgggggggaagatgaacacgctgggggcggccacggtccgcttgatctccaccttggtgccgccgccgaaggtcaggggcaggtcccggctgtgctggcagtagtacacggcgaagtcctcgggctccaggctgctgatggtcagggtgaagtcggtgccgctgccgctgccgctgaaccgggcgggcacgccgctctccaggtagctggccaggtagatcagcagccggggggcctggccgggcttctgctggtaccagtgcaggtagctgtagccgctggtgctcacgcccttgctggcccggcagctcagggtggcccgctcgccggggctcaggctcagggtggcggggctctgggtcagcacgatctcggggccggggttctcctccacgtcgccggcctgcttcagcaggctgaagttggtggcgccgctgcccttgcccaggctcaggctcaggctcttctgggtgtagtggttgtgcagggcctcgtgcatcacgctgcagctgaacacgttgccctcctgccaccggctcttgtccacggtcagccggctgtacaggaagaagctgccgtcgctgtccagcacggggggggtggtcttgtagttgttctcgggctggccgttgctctcccactccacggcgatgtcgctggggtagaagcccttcaccaggcaggtcaggctcacctggttcttggtcatctcctcctggctggggggcagggtgtacacctggggctcccggggctggcccttggccttgctgatggtcttctcgatgctgctgggcaggcccttgttgctcaccttgcacttgtactccttgccgttcagccagtcctggtgcagcacggtcagcacgctcaccacccggtaggtgctgttgaactgctcctcccggggcttggtcttggcgttgtgcacctccacgccgtccacgtaccagttgaactgcacctcggggtcctcctggctcacgtccaccaccacgcaggtcacctcgggggtccggctgatcatcagggtgtccttgggcttgggggggaacaggaacacgctggggccgcccaggaactcgggggcggggcagggggggcagggggggccgtacttgctctccacccgcttgtccaccttggtgttgctgggcttgtggtccacgttgcaggtgtaggtcttggtgcccaggctgctgctgggcacggtcaccacgctgctcaggctgtacaggccgctgctctgcagcacggcggggaaggtgtgcacgccgctggtcagggcgccgctgttccagctcacggtcacgggctcggggaagtagtccttcaccaggcagcccagggcggcggtgctctcgctggtgctccggctgcagggggccagggggaacacgctggggcccttggtgctggcgctgctcacggtcacggtggtgccctggccccagtagtcgaagcccatgtcgaaccggtagtcccgccgggcgcagtagtacacggcggtgtcgtcgaactgcaggctcttcagctccatgtaggcggtggtggtgctgctgtcggtggtcagggtcacccggttcttgaacttctcgttgaagttggtgccgccgttgctggggttgatgccgcccatccactccaggccctggccgggggcctgccgcacccagtacatgtagtagttggtgaaggtgtagccgctggccttgcagctcaccttcacgctggcgccgggcttcttcacctccacgccgctctgcaccagctgcacctgcatggatccagcttgggtctccctatagtgagtcgtattaatttcgataagccagtaagcagtgggttctctagttagccagagagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacgcgtatatctggcccgtacatcgatcatcgatgaattcgagctcggtacccggggatcctctagaccggcttcccggtatggtaattagaaacttttaataggcggtcccggccgccatccccgcgcatggtaattagcaacttttaatgggccggcgttcccgctcgcggtaattagcagcttttaacgggccgccattcccgcttatggtaattaaaaacgttcggacggcccctcgctccccgcgtaattactccctcggggttccgggttatgctgattactttcttggcagaacacgcagagcctcgcgcgccgccgggtgggtgggctgatcggcccctattggtcccctgggcttcctagtatgctaatgaatttctccccgggggcgggcaccactcagggccgcgccggcggggcgccggggggactcccatctgcgtcggcggggggcggcgcatgctaatggggttcttggagtacacccggttggtccccggggacggggccgccccgagagggggggattccctccctccgcccccgccggggcgcgcggctattgggggaatcgtaaatgccgcccctttgggggagtggataggcgccgggtataaggcagccccgtgtgacggtcgggccgcattcgcaccccggcactgcgagcgacggagcggcggcccggcgggaggaggagacccggagagacagagactaaaacccggcaagagagagaccgcgggccgccgtctcgagtctaccctaccccggctcatggaaccccggcccggcacgagctcccgggcggaccccggccccgagcggccgccgcggcagacccccggcacggtgagagggcgacccccgggtctcaggcccccccttttccccggaccacccggctgcgggttgggggtggtcgcgggcggtgggctcgggggcggggacgcttgacggggccgacccccggcccgcttaagcggtcgggggacccccgtgggccgtgcgccgccccccgaccctctgggggggcgagggaggcagggaggagcccgagagcgggggacagggggggagacgaggggtcggaatccaaaggacgcagaccacctttggttacggacccctttctcccccccttccgaacaaaaagcagcgggcggggggccggggtgagggagggacacgggggacacggcgcgggggtcccgcctcacgccccgcgccctctaaatcccccccgttgctttgtcaagcagcccgccgccccgcacgcctgggggatgctcaacgacatgcagtggctcgccagcagcgactcggaggaggagaccgaggtgggaatctctgacgacgaccttcaccgcgactccacctccgaggcgggcagcacggacacggagatgttcgaggcgggcctgatggacgcggccacgcccccggcccggcccccggccgagcgccagggcagccccacgcccgccgacgcgcagggatcctgcgggggtgggcccgtgggtgaggaggaagcggaagcgggaggggggggcgacgtgtgcgccgtgtgcacggacgagatcgccccgcccctgcgctgccagagttttccctgcctgcaccccttctgcatcccgtgcatgaagacctggattccgttgcgcaacacgtgtcccctgtgcaacaccccggtggcgtacctgatagtgggcgtgaccgccagcgggtcgttcagcaccatcccgatagtgaacgacccccggacccgcgtggaggccgaggcggccgtgcgggccggcacggccgtggactttatctggacgggcaaccagcggacggccccgcgctccctgtcgctggggggacacacggtccgcgccctgtcgcccacccccccgtggcccggcacggacgacgaggacgatgacctggccgacggtgagggcgggcgggggtcgggcgggggtcgggcgggggtcgggcgggggtcgggcgggggtcgggcgggggtcgggcgggggtcgggcgggggtcgggcgggggtcgggcgggggtcgggcgggggtcgggcgggggtcgggcactaaccgggggctcccgtctctgtctccctctgcagtggactacgtcccgcccgccccccgaagagcgccccggcgcgggggcggcggtgcgggggcgacccgcggaacctcccagcccgccgcgacccgaccggcgccccctggcgccccgcggagcagcagcagcggcggcgccccgttgcgggcgggggtgggatctgggtctgggggcggccctgccgtcgcggccgtcgtgccgagagtggcctctcttccccctgcggccggcggggggcgcgcgcaggcgcggcgggtgggcgaagacgccgcggcggcggagggcaggacgccccccgcgggacagccccgcgcggcccaggagccccccatagtcatcagcgactctcccccgccgtctccgcgccgccccgcgggccccgggccgctctcctttttctcctcctcctccgcgcaggtgtcctcgggccccggggggggaggtctgccacagtcgtcggggcgcgcggcgcgcccccgcgcggccgtcgccccgcgcgtccggagtccgccccgcgccgccgccgcccccgtggtgtctgcgagcgcggacgcggccgggcccgcgccgcccgccgtgccggtggacgcgcaccgcgcgccccggtcgcgcatgacccaggctcagaccgacacccaagcacagagtctgggccgggcaggcgcgaccgacgcgcgcgggtcgggagggccgggcgcggagggaggacccggggtcccccgcggcaccaacacccccggtgccgccccccacgccgcggagggggcggcggcccgcccccggaagaggcgcgggtcggactcgggccctgcggcctcgtcctccgcctcttcctccgccgccccgcgctcgcccctcgccccccagggggtgggggccaagagggcggcgccgcgccgggccccggactcggactcgggcgaccgcggccacgggccgctcgccccggcgtccgcgggcgccgcgcccccgtcggcgtctccgtcgtcccaggccgcggtcgccgccgccgcctcctcttcctcctccgccgcctcctcttcctcctccgccgcctcctcttcctcctccgccgcctcctcttcctcctccgccgcctcttcctcctccgccgcctcctcttcctcctcctcctcctccgcctcttcctctgcgggcggggctggtgggagcgtcgcgtccgcgtccggcgctggggagagacgagaaacctccctcggcccccgcgctgctgcgccgcgggggccgaggaagtgtgccaggaagacgcgccacgcggagggcggccccgagcccggggcccgcgacccggcgcccggcctcacgcgctacctgcccatcgcgggggtctcgagcgtcgtggccctggcgccttacgtgaacaagacggtcacgggggactgcctgcccgtcctggacatggagacgggccacataggggcctacgtggtcctcgtggaccagacggggaacgtggcggacctgctgcgggccgcggcccccgcgtggagccgccgcaccctgctccccgagcacgcgcgcaactgcgtgaggccccccgactacccgacgccccccgcgtcggagtggaacagcctctggatgaccccggtgggcaacatgctctttgaccagggcaccctggtgggcgcgctggacttccacggcctccggtcgcgccacccgtggtctcgggagcagggcgcgcccgcgccggccggcgacgcccccgcgggccacggggagtagggggagctaacactcggcttgctgcccaaagggaagccgccccccaccggaccaccggccgaggcgcctcgggggcagggggaggtgggggggaaagacggggaggagacaggaagtgggggtgggagtggggggggacggacacggccccgaacagcaacacacaccagcattttgttatggactttctggccttgttgaaaacttgaggaaaaaaaactttatatttataaaaattttacaataaagttttgtgatgcttttgacacactttgttgttggcctttgatgcagctcccccgcgcaggggggccggggatggggggggggaaagggaggaggaggagggggggcgggcacgagaagccgcccccacccccgaggcctgttggtctttatgatagaacagagccggggcccggcctgcgttctggctccctgtcttggtgggtgggcgggctggctggcgggtaaaaaaagagtgtgtccgtgttgacagggaggggggcccgatcgtgcagagcacgcacgtctggccggccagaccctgggggtggtgggcaggagtgggagggcgcctggctcggggagggaggagggggggggtcagccgcaccaccggcgcgaagccaggggccagggaactttgatagagagggggggaaagtggggcgggggcgagggcggttgaatcacaacgcatgcacgccctctgcccccggggacgggtgggaggaaggaggagggagaagagaagacccgaggcatgcacccgcacttacgcccgtgcccacccccgccccggcgcccaccccgcccgcacacctgcccgccacgcccgcccctcctcaccctggctgggagaaaggaggaggagcaggaagaggagacccgaggcatgcaaccgcactcaccccaccccgcccgcacacctgcccgccacgcccgcccctccttaccctggctgcggggagactcccatcggggcgagggggctcgcgcgttcgcaacaccacaccacaccacacggcccaccacaacacggcccaccacgacacaacacgacacgacgcgttttgcggggcatgcaagtcgacacaccgcgcgcgtgcctacctttccctagcggccccggcccccggcccgtttccttccgccaccactaccaccacccccccgcccgcgcccacgcggtagaggaaggggacgggcgccacacccacggctgtggctgggcacgcgcctttggggttgttgggggggggtgaccggcgcgtgggggcggtgggcgtatgggcccgacccgcgcctgccccccctgggaacgacgcccccggacgacaccacgggggggggaaacgggggtgggtggaagggaagaggaaggagaaagggggggtggatccgaacacgccggatccgcgaaaataataacaaaacaaacaaaaacagaaacaaaaacaaaaacacctagaaaaaaaggatacgggttggctcgcgggcggtgcggctgacctgcctgccctttctgggacccccgcctcgtgtttcttgaaagggggaggaagaacagttctcccccaacccctgctctcttctctcttccgcccgccccccccccctctcccgccgcctcagcagaagctcacctgtacgaccctaaacctacctgcgagaacgcgcggcgttcgaggggcgcgctctctcacacgagacacacgcaggcgccccccccccccggagcctgggtcccccggcggacggctcacgcggcgcggcgtctcggtgggacgcgggcagagggcggcggcggcgggggggggggggaaatgtgaggagagcgagacagagagagagaaggaagagggaaggggcgcggcgggacgggggaagacgaggagaagggaaggggcgagggtcgggcccgggagcggggcggccgggagggagaagaaacggaacgcggaaacgccgccggcgcggcccggggccccggggcccccgcgctccgccgggggcccgggccggaccgccgggcgggggacgccttccgcccggcgccgggcggctacccgggacccccggccgggaatcgaaaaaagcctccgggggcccctttcgcgcctttcgcgaacgcgcggcgccggagggggcggccgccgaggtgcgggggcccctccggccggggcgcacctcggcggccaagccccggcccgcccgggggtccccgaggcagaggcggaccctcggaggcgcggaagaagacgggaggcgggggaaaaaagggggaagagagggggaggtagggaggggagaggagaagggcgcgccggtgcgcggagcagccttccttctccggagtccctctcgatcggcggcgggcccctgcgttcgttgctgccgcgcccccggttttataaagacagggatgacgcagcagaaatgcccacagcaacacgcgggcggggctcgggctctccggcggcttaatggatctccgggcacggcgcccgcaaccgcagagcactcagctggcgcgcccccccccaacgtgggagtgtttaatggaagggcgtggggccggccgccggatgcccgcgggggcctaatgcggcgggaggcgtgggccgctggcgccgcggcccgtctgctggcccgcggcccgtctgctggcccgcggccacgtaaacaatgacacaggggttctctccgccgcggccggcgcggggcgttgccggcccggcccggccccggagcccgcggcgctgctcggctgcggccgcgggctccgggggctccgcactctgcccggctcgccccgtcccccctcttgctgcttttccgcgcgcctctctttcccgttgctttccctctccccccccccccctctctctctctctctctctctctccgccatcctcccgcccggccgcccactccccgctcggcctctccggctgcggtgcttgggtctccttcgtcgggcggcggggggggggcgtcgggactcgcggagggccggagaatggaaggcgaggggatgcaggaggaggatcgggactccccatcttctgcccttccatcctccgtttttccgctttccaccgccgccgccaccacccccccttccttcgcccgcccgcctcgccccggacccctcccccccgtgttccccccatcgttcaccaccacgccccccaccgcgccttggctgtttggggggtggcggcggtggtcggcgtgctgccggaggctgcgggcgcggggtaggtgggtgggcgggtggtgggggggggcccggctgcgtctcgccgcgatcccgccggtggggcgcggcggcggtcggggtggggggagagtgtcgtgggtgtgttttcgtgtcccccaccaccactcccaccccgaccgccgccgcgcccgcgtttctgccgcccgcgcgctcctgtgtggaccccggggtgggcggcggggggggggtgccgtgggtgtggcggcggggcgcgggccggggccggggctcgctggtccgccgaagtaaagaaaagatcgccaccgtgtgttcgtctgtgtgttctgcgcggcgccggggcccccctgccgggcggggcggtggggcggggccggggtcgcggcggggaaggaaggaaagaccccggaagcgccgggagggggcgccggcgcgacgcgggcggccgggcgggggcgcgcggcggccgggcgggggcgcgcggcggccgggcgggggcgcgcggcggccgggcgggggcgcgcggcggccgggcgggggcgcgcggcggccgggcgggggcgcgcggcggccgggcgggggcgcgctttccccgcgtcgcccctcgggttcccaagacctatcacgtgtgcgcaggggaggggaggacgcgggggaggggaggacgcgggggaggggaggacgcgggggatatataaagcggtagaaagcgcgggaatgggcatattggacccgcgtgattcggttgctcgcggttgtcttgtttggacgttttttatgcgggaacaagggggcttaccggttacactgtccgctcgctatggggttcgtctgtctgtttgggcttgtcgttatgggagcctggggggcgtggggtgggtcacaggcaaccgaatatgttcttcgtagtgttattgccaaagaggtgggggacatactaagagtgccttgcatgcggacccccgcggacgatgtttcttggcgctacgaggccccgtccgttattgactatgcccgcatagacggaatatttcttcgctatcactgcccggggttggacacgtttttgtgggataggcacgcccagagggcgtatctggttaacccctttctctttgcggcgggatttttggaggacttgagtcactctgtgtttccggccgacacccaggaaacaacgacgcgccgggccctttataaagagatacgcgatgcgttgggcagtcgaaaacaggccgtcagccacgcacccgtcagggccgggtgtgtaaactttgactactcacgcactcgccgctgcgtcgggcgacgcgatttacggcctgccaacaccacgtcaacgtgggaaccgcctgtgtcgtcggacgatgaagcgagctcgcagtcgaagcccctcgccacccagccgcccgtcctcgccctttcgaacgcccccccacggcgggtctccccgacgcgaggtcggcgccggcatactcgcctccgacgcaactagccacgtctgcatcgcaagccaccctgggtcgggagcaggacagccgacccgtctagcggccgggtcggctgtccagcgtcgtcgccctagaggctgtccgccgggcgtgatgttttccgcatctacgacccccgaacagcccctggggctgtcgggcgatgcgacgccgcccctgccgacttccgtgcccctggactgggccgcgtttcggcgcgcgtttctgatcgacgacgcctggcggcccctgttggagccggagctcgcgaaccccctaaccgcgcgcctcctcgcggagtatgaccgtcggtgccagaccgaagaggtgctgccgccgcgggaggatgtgttctcctggacgcggtattgtacccccgacgacgtgcgcgtggttatcatcgggcaggacccgtaccaccatcccggccaggcgcacggcctggcgtttagcgtgcgtgcggatgtgccggtgcctccgagtctacggaacgtgctggcggcggttaaaaattgttaccccgacgcgcgcatgagcggccgcggctgcctggaaaagtgggctcgcgacggcgtgctgttgttgaacacgaccctgaccgtcaagcgcggggcggcggcgtcccactccaagcttggatgggaccgttttgtgggcggggtggtccgacggctggccgcgcgccgcccgggcctggtctttatgctctggggcgcccatgcccagaacgcgatcaggcccgaccctcgccaacactacgtcctcaagttttctcacccgtcgcccctctccaaggtcccgtttgggacgtgccagcatttcctcgccgcgaatcgctacctcgaaacccgggacattatgccgatcgactggtcggtataagatgccgacatccggggtcttgatttacgagggggcaattaataaagactgttgatggttaaatctcgggtctcataccggtccgtgatgtcgggcgtgggggaagagagggtcccctctgcgtttactatccttgcctcgtggggctggacgtttgcaccccagaaccatgatcctggcgcgtcgccgaatacgacgcccatagagtcgattgcggggaccgcaccggacgcgcacgtggggcctctcgacggagagccggaccgggatgcgatctccccgcttacgtcgagcgtggccggcgacccgccgggggcggacggcccctacgtcacctttgatactctgtttatggtatcttcgatcgacgaactggggcgccgccagctcacggatacgatccgtaaggacctgcggctgtcgctggccaagttcagcatcgcgtgtaccaagacctcgtcgttttcggggacggccgcgcgccagcgcaagcgcggagcaccgccgcaacgcacatgcgtaccacgcagcaacaagagcctccagatgttcgttttgtgcaagcgcgccaacgccgcgcaggtgcgcgagcagctgcgggcggttattcggtcgcgcaagccgcgcaagtattacacgcggtcctcggatgggcggctctgcccggccgtccccgtgtttgtacacgagtttgtttcgtccgaacccatgcgcctccatcgagataacgtcatgctgtctacggaaccagactaagcacccccgccgtcccctttcttttccccctacccttccccccgttactgatgtgttgtgacgtttcaataaataacacgtagcttattttgttggatgatggattgattgattttattgaccgttcgttcgcccggcggtgccgtcgccgcgcgcagagggaatatgcaagcgggcggggtggggaggaaagaaggtttcaggttccgggggttgggtctgcgtcgtccagggtggggctgatctgaatttcccgcagaacctcgaccagtaggtctgttgtgtttgctgggaactcgcccgccgttggggatacgggggcggggggtgtggtcgggcggacgtccaggggtgcgttatcgcacccccgcgccgcctcgggggccgtcccgtagatcgttgcggtgatgtagatggtgtccggggtccacaccaccgtcaggatgccggccgtcgcactccggacgctttcgccgtgcgatgagctgacccaggagtcaaaggggtacgcgtacatatgggcgtcccaccagcgctccagcctctgggtactagcgcgtcctataaagcggtatgcgcaaaattcggcacgacagtcgataatcaccagcagcccgatgggggtgtgttgtatcaccacgcctccgcggggcaggcggtcctggcgcgctcgaccccgcgtcagaaccgcgcgcgtccctgactcaaacacgtgcaccacctgtgccgcgtccggcagcgcgctcgttagcgacgccctggggtgatgtaggctgtacgcgatggtcgtctgggggttccccatgtctcgggggggtgggggtgaatgtcacccggcccgggtgcggtgggaacgcgagggaatggagggttaatagacaatgaccacattcggatcgcgtagagcagatagtatgtgctcgctaatgacgtcatcgcgttcgtggcgctcccggagcgggtttagattcatgtgcaggaactcggatgaggtggtgcgggacatggctacgtacgcgctgtttaggcgcaggtttccgggcgtgaagcatatggcgaccttgtccagactgagcccctgggagcgcgtgatggtcatcgcgagtttggagctgatgccgtagtcggcgttgatggccatggccagctccgtggagtcgatcgactcgacaaactcactgatgttggtattgacgacagacatgaagccgtgctggtcccgcaggacgatgtagggcaggggggactcctccaagaactcggccacgccggccgtcgcgtgccgccgccgcagctcctccgcgaacgcgaacacccgggtgtacgtgtaccccatcagcgtgtagttgtccgtctgcagggccacggacatcagccccccgcgcggcgagccggtcagcagctcgcagccccggaaaatgacattgtccacgtaggtgctgaagggggcgctctcaaacacctccccgaagagctcccgtaggataaggtatcgccccagaaaggccctcttcaggagcccaaactgggcgtggacggccgcggtggtctcaggctcttcgagggcgtagtggcagtagaacacgtccagctgctgttcgtccagcccggcgaagataacgtcaaggtcgtcgtcggggaagtcgtccgggcccccgtcccgcgggcccaggtgcttaaaattgaacgcacgctcccccggagagcggtcgctggtgtcggcggccctggttgccgatgcgccggcggcgtcccggcgtagcgacaggagttctgccgtcagctcccctaggcggccgtaggccagggtcctctgggtcgcgtccaggccggggcgctggagaaagttgtaaaagtgaatcagcccgccgaacatgagccgcgacaggaaccggtaggcgaactccaccgaggtctccccctgggtcttcacgaagctgtcgtcgcgcagcacagcctcgaaggtccgaaacgtcccgtcgaacccaaacaccatctttcggaggcgcgcggtcaccgcgacctggctgttgaggacgtacgtgatgtcgttccgggccacgactagctgttgcttgctgtgcacctcacagcgcacgtgccccgcgtcctggtcctgactctgggagtagttggtgatgcgactggcgttggccgtgatccacttttccatggtcagcgtgggttgctgcgtgagccgtcgatactcgtcaaactctttgaccgacacaaacgtgagcacggggagggtaaacacaacaaactccccctcgcgagtcacctttaggtaggcgtggagcttggccatgtacgcgctgacctccttgtgggacgagaacagccgcgtccaccccggaaggttggccgggttggtgatgtaactttccgggacgacaaagcggtccacaaactgcatgtgctcctcggtgatgggaaggccgtactccagcaccttcatgaggttcccgaactcgtgctccacacatcgcttgttgttaatgaaaatggcccagctgtgcgagaggcgcgtgtactcgcgtagggtgcggttgcagatgaggtacgtgagcacgttttcgctctgccggacggagcatcgcagtttttggtgttcgaaggtggactccagcgaggccgtctgggtcggcgaccccacgcacaccagcaccggccgcaggcggcccgcgtactggggggtgtggtacagggcgttaatcatccaccagcaatacaccacggtcgtgagtaggtgccgccccaggagcccggcctcgtcgatgacgataatgttgctgcgggtgaaagccggcagcgccccgtgtgtgaccgaggccaggcgcgtgagggcaccctggcccagccccaaagtctgctctagggcggtgagggcgtggaactcgtttcgcgcgtcttcgcccccgtgcgccgccagggcccgcttggtgatgtcgaggatcacctcccagtagtacgtcaggtctcgccgctgcaggtcttccagcgaggcggggctgctggccagggtgtacgggtgctgccccagctgggcctggacgtgattcccgcgaaacccgaactcgtgaaagatggtgttgatgggtcgactcagaaacgcccccgagagcttaacgtacatgttctgcgccgcgattcgcgtggcgcccgtgaccacgcagtccaggacctcgttgagggtctgcacgcacgtactctttccggatccggcgttgccggtgatgagatacgccgcgaacggaaactcccggagcggcaggccggtcgggacctccaaggccgccacgtcccggaaccactgcaggcgcggcacctgcgtgacgtcgagctgctgctgcgagagctctcggatgcgtgcgatgattggttggaccccgtgcatggacgtaaaatttaaaaacgcctcgtccctgaaccgcacggcgggtctggccccgggctgctgtgggggcggacctggtgcccggacgtcccgcgagccctccccgccggacgccgccatggccgcacagcgcgcgcgggcgccggcgatgcggacgcggggcggcgacgcggcgctatgcgcccccgaggacggctgggtgaaggttcaccccacccccgggacgatgttgttccgcgagattctcctcgggcagatggggtacaccgagggtcagggggtgtacaacgtcgtccggtccagcgaggccgccacccgacagctgcaggcggcgatcttccacgcgctcctcaacgccacgacgtaccgggacctggaggaggactggcgccgccacgtggtggcccgcggcctccagccgcagcggctggttcgcaggtaccggaacgcccgggagggcgatatcgccggggtggccgagcgggtgttcgacacgtggcgatgcacgctcaggacgacgctgctggactttgcccacggggtggtagactgctttgcgccgggcggcccaagcggaccgaccagcttccccaaatatatcgactggctgacgtgtctggggctggttcccatattgcgcaagacgcgcgagggggaggcgacgcagcgcctgggggcgtttctcaggcagcacacgctgccccggcagctggccacggtcgccggggccgcggagcgcgccggcccggggcttctggatctggccgtcgcgttcgactccacgcgcatggcggaatacgaccgcgtgcacatctactacaaccatcgccggggggagtggctggtgcgcgacccggtcagcgggcagcgcggcgagtgcctggtgctgtgcccccccctgtggaccggcgaccgcctggtcttcgattcgcccgttcagcggctgtgccccgagatcgtcgcgtgccacgccctccgggaacacgcgcacatctgccgtctgcgcaacaccgcgtccgtcaaggtgctgttggggcgcaagagcgacagcgagcgcggggtggctggcgccgcgcgggtcgtcaataaggcgctgggggaggatgacgagacgaaggccggctcggccgcctcgcgtctcgtgcggctcatcatcaacatgaagggcatgcgccacgtgggcgacatcaacgacacggtacgcgcctacttggacgaggcgggggggcacctgatcgacacccccgccgtcgaccacaccctccctgggttcggcaagggcggcaccggccgcgggtcggcgccccaggacccgggggcgcgaccgcagcagcttcgccaggcgtttcagacggccgtggtcaacaacatcaacggcatgctggagggctatatcaataatctctttggaaccatagaacgcctgcgagagacgaacgcgggtctggcgacccagctgcaggcgcgcgaccgcgagctgcggcgcgcccaggcgggggcgctggagcgggagcagcgcgcggcggaccgggcggccgggggaggcgcgggccgcccggcggaggcggatcttctccgggccgactacgacattatcgacgtcagcaagtccatggacgacgacacgtacgtggccaacagtttccagcaccagtacatccccgcgtacggccaggacctcgagcgcctgtcgcgcctctgggagcacgagctggtgcgctgcttcaagattctgcgccaccgcaacaaccagggccaggaaacgtcgatctcgtactctagcggggcgatcgcctccttcgtggccccgtatttcgagtacgtgcttcgcgccccccgagcgggcgcgctcatcaccggctccgatgtcatcctaggggaggaggagttatgggaggcggtctttaagaaaacccgcctgcagacgtacctgacagacgtcgcggccctgttcgtggcggacgtacagcacgcggctctgccccggcccccctccccaacccccgccgatttccgggcgagcgcgtccccgcggggcgggtcccggtcccggacccggacccgatcccggtcgcccgggagaacgccgaggggtgcgccggaccagggctggggcgtcgaacgcagggatggccgaccccacgcccgccgatgagggaacggccgccgccatcctcaaacaggccatcgccggggaccgcagtctggtcgaggtggcggaggggatcagcaaccaggcgctgctgcgcatggcctgcgaggtgcgccaggtcagcgatcgccagccgcggtttaccgcgaccagcgtcctgcgcgttgacgtcacccccagggggcggttgcggttcgttctggacgggagttccgacgacgcgtacgtggcgtcggaggattactttaagcgctgcggggaccagccgacgtatcgcggttttgcggtcgtcgtcctcacggccaacgaggaccacgtgcacagcctggccgtgccccccctcgttctgctgcaccggctctccttgtttcgccccacggacctccgggacttcgagctcgtctgcctgctgatgtacctggagaactgtccccggagccacgccacgccctcgctgttcgtcaaggtgtcggcgtggttgggggtcgtggcccgccacgcgtctcccttcgagcgcgtccgctgccttctcctccgcagctgccactggatcctgaacacgctaatgtgcatggcgggcgtgaagcccttcgacgacgagctagtcctgccccactggtacatggcccactacctgctggccaacaatccgccccccgtcctctcggccctgttttgcgccaccccgcagagctctgcgttgcagttgcccgggcccgtcccccgcacggactgtgtggcctataacccggccggcgtcatgggaagctgctggaattccaaggacctgcgttcggctctggtgtattggtggctttcggggagccccaaacgacggacctcgtcgcttttctatcggttttgctaactccggaaaataaacgtgttttttatggaacgttccccacctgtcgtgtcatctctcgggggatggtggtgggcctgtgtgtgtgtcttgtgcaccgaaggaggaaagtgggggggtggtggtgctggtggtggaaagacatgatagagggaacaaagaaatagaagaaaaccacaaccggcgcgtgccagtaaatacggacgcgcgcacacgcggggggtaagttggagcacggggccccggtttattgaccaaattcagggaaacagaaaccgcatcttttcctcgaaagggtacacaaagctcccgccctcgccccacacgccttccagaacccccgtaaacaccagttgaatctcgcgcaggatctcgcgcaggtgatgggcgcagtccacgggggggagcaccaagggccgcgggtacagatccacggggacgccgaccgactccccgcccccgggacatacgcgcacgacgcgtctccagtattgctccgcgtccagcagggcgcctccgcggaaggccgtttggggcagggggtcgtcggcctcgcctgggggggtcagaacgctccagtactccgcgtccagacgcctcccgaaggcatccaggacaaagcggtcacaggcgtcctccatgacgccccgggccgcgcacacggcctcctccggcgggccggcggccggccgccggaggattcgtctcagcgcgtcgcgcataacctcggccgccgcggcgtacgcgggcccgcggagaggaaatccctgcaggaagtcggtgtcatcgcgggagttccagaaccacgccccggtctggctccaggtgacgacgtgggtgtagacgccctctggcgccagggagggggcgaggcgcgggcgtatgccgttggccgaaagtacggcgcgcacggacgcctcgagggcccggcgggcgtcctggatcgcgccgtgcgcggcgtccgcgtccccggggtccacgttgaacagcccccagaacgcagccccggtgccgccgcagaccgcaaacttcaccgagctggccgtctgctcgatctgcaggcagacggcggccatgaccccgccgagcagctgccggagcgcggggcaggcgtcgcacgcgtccggcaccaggcgctccagcacggcccgggcccagggctccgagggggcggccgccaccagcgcgtccagcctttccaggcccgcccgcccccgggcttccggcagcccggcctccccgaggcccgcgagggcggccaggagctgggcctggagcccggagaaacaaaaccgcgccgtccagaccggcccgacggccgccggggggtcgagtagttggatggtggtggccgtggggtgccaccgcgccaccgcttcccgaaaggcgggcaggaggcggccggccgcctccgaggccacggccggccatgcccgcgggggcaggacgaccctggcgcccaccgcgggccaggcccccaggcacgcggcatgggtggccgcggcgccccgcaccaggtcacgcgccgactcggcggcggcggcggccggcacggtaaacgtgggccagcccggaaatcccagcacggcaaagtattggacgggccctccccggacctcaaacccgggccccagaaaagcgaagacgggggccagggctccgggggcggcgtggaccgtggtatgccactgccggaagagggcgaccagcgccggggcggagaacccgtcgccggcgctcacgaagtagtcgtagccgcgcggcagcagcacccgcgccgtgacccgctgcgggtgtccgcggggccgcaggccgacctcgcacacctcgaccaggtccgcgaaggcgccctccttcctggtcggcggaaacgccagggtggtgtattcgcgcgcaaaacgcgcggtcctcgtcgtgatggtgacggcgagcgaggcggaggacgcgcactgggggctgtcgcgaatggcggccaggcgcgcccacgccaaccgcgcgccggggtgctcggcgacgcgcgcggacagggccagcgggtcgacgtcgaccttggcctccacgtccaggagggcggcgcgaggagcggccggcgggccccacgacgccctttcgaccctcacgaccagacccgtctgcgggtcccagcccaggcgcagcgggacgaagagggccaccggccccgtctggcgctccagggccgccagaacgcacgcatacagcgcccgccacagggtcgggtcccccaggggctccagcggggaggcggccggggccgtcgcggcgcgggcggccgcgacggccccggcggccgagacgtcgggggagccgtagaagtcctgcaggtcggacgaaccaacggacacctccgcgaagcgcgcgcgcgcctcccccgcggcgtcgcgacagaccagatacagcagggcgtggaggcagtcgcgcgtgcgcgggggcagccataccgcgtatagggtaatggcgctgacgctctcctccacccaaacgatgccgggggcttccatgccacgacgcccgggggttgccgtgtatcgaacgagcgcggccccagacttatagggtgctaaagttcaccgccccctgcatcatgggccaggcctcggtgggaagctccgacagagccgcctcgagaatgatgtcagtgttgggctgggcgccggaggcgtgcgtgcgcaagcagcgcccccacgcgggcgcgcgcagcttgaagcgcgcgcccgcaaactcccgcttatgggccatcagcagcgcgtacagctgtctgtgcgtccggcaggcgctgtggtcgatgcggtgggcgtccagcagctccacgatggctcgcttggtgaggtttttaacgcgccccgccccgggaaacgtctgcgtgctcttggccagctgcaccccgaacagttcgccccagatgatcttgaacagcgacagcgcgtgctccgtctcgctcacggacccgcgcggggggcagccgctcagggcgtcggccacgcgcttaaccgcgtcctccgacagcaaggggccgtcggtcacgttacagtggcccagttcgaacaccagctgcatgtagcggtcgtagtgggggttcagcagctccagcacgtcctcggggctaaaggttcgccccgaccccccggccatcgagtcccactgcaggcacgcggccatggtgctgcacagacggaacagctcccagacgggggcgacgtttagggtggggtgtagggccacaagctccagctctccggcggcgttgatcgtggggatgacgcccgtggcgtagtggtcgtaaagccgccggaagatggcgctgctatgggcggccatggggacgcgaagacaggcctccagcagcaccaggtagatgaaccgcgtgcggccgaccaggctgttgaggccgcgcatgagcgcgaccacctcggccggcgcgacgtccggccggaggtacttttcgacgaaaaggcccacctcctccgtctcggcggcctgggccgacagggacgtgtcggggtcctggcagcgcagctcccgcagatcccgctgggccctcagggcatcaaaatgtatcccccgcaaaaacagacaaaagttcctcggggtcagcgcggcgtcgtggccccagaaccgcacgtgcatgcagttgagggtcagaagcatgtggaggatgttaagactgtccgcgaggcacgccagcgtgcacctctcgaagtagtgcttgtaccggaatttgctgtagatgcgcgacccccgcgcctgcgccgcgtcggcgtgcgacgcgtcgcagcgccctttgaaccggcggcacaacaggttcgtcacctgggaaaactgtgccggccactgcccgctggcgctcaccacgtggttgagcagcatgggcgtaaagacgggctccgagcgcgccccggacccgtccatgtagatcagcagctcccccttgcggagagtccgtacccgccccagcgactggtacacggacaccatgtccggcccgtagttcatgggtttcacgtaggcgaacatgctgtcaaagtgcggcggatcgaagctaaggcccaccgtcacgaccgttgtgtagatgaccacccggtaccggccccatgtggtcacgtcgccgggcggggtgagcgagtggagcagcagcacgcggtccgtaaactgccggcagaacctggcaacgacctccgcgaaggagaccgtcgacgagaagatgcagacgttatctccgccggccaggcgcgcctccagctccccgaagaaggtggcgtccgggggggcgtccggggggggcgccccgcccgccggccccggcgggcgcagggccgcctgcaggacctcgggccccaggcgcgggagaaacagacaacggcgcgccgaaaatccgggcatggcgtactccccgatgaccacgtgaacgttcttttcgccccggaggctgcacagaaagtccaccagctgcgcgttggcggtggcgtccatggcgatgatccgcgggcacgtgcgcagcaggcgcagcatcaacgcgtcgacgcggcccagctgctgcatcgtcggcgagtacagttggcccaacgtcgacatgacttcgtccaggacgagcacgtcgtagttgttcaacaggttcgggcccacgcgatgaagactttccacctgcacgatgagacggtggaaggggcggtcgttcatgatgtaattggtggatgagaagtaggtgacgaagtcgggcaaccctgactcagcgaaccgcgtcgccagggtctgagtaaaactccgacgacaggagacgaccagcacactcgtgtccggagagtggatcgcttcccccaaccagcggatcagcgcggtagtttttcccgagcccattggcgcgcggaccacagttacgcaccgggccgtcggggcgctcgcgtccgggaaggtgacgggtccgtgttgctgccgctcgatcgttgttttcgggtggacccggggaacccactcggccaaatcccccccgtaaagcatccgcgccagcgatacactcgacgtgtactgctcgcactcgtcatccccgatgggacgccgggcccccaggggatcccccgaggccgcgccgggcgccgacgtcgcgcccggggcgcgggcggcgtggtgggtctggtgtgtgcaggtggcgacgttcatcgtctcggccatctgcgtcgtggggctcctggtgctggcctctgtgttccgggacaggtttccctgcctttacgcccccgcgacctcttatgcgaaggcgaacgccacggtcgaggtgcgcgggggtgtagccgtccccctccggttggacacgcagagcctgctggccacgtacgcaattacgtctacgctgttgctggcggcggccgtgtacgccgcggtgggcgcggtgacctcgcgctacgagcgcgcgctggatgcggcccgtcgcctggcggcggcccgtatggcgatgccacacgccacgctaatcgccggaaacgtctgcgcgtggctgttgcagatcacagtcctgctgctggcccaccgcatcagccagctggcccaccttatctacgtcctgcactttgcgtgcctcgtgtatctcgcggcccatttttgcaccaggggggtcctgagcgggacgtacctgcgtcaggttcacggcctgattgacccggcgccgacgcaccatcgtatcgtcggtccggtgcgggcagtaatgacaaacgccttattactgggcaccctcctgtgcacggccgccgccgcggtctcgttgaacacgatcgccgccctgaacttcaacttttccgccccgagcatgctcatctgcctgacgacgctgttcgccctgcttgtcgtgtcgctgttgttggtggtcgagggggtgctgtgtcactacgtgcgcgtgttggtgggcccccacctcggggccatcgccgccaccggcatcgtcggcctggcctgcgagcactaccacaccggtggctactacgtggtggagcagcagtggccgggggcccagacgggagtccgcgtcgccctggcgctcgtcgccgcctttgccctcgccatggccgtgcttcggtgcacgcgcgcctacctgtatcaccggcgacaccacactaaatttttcgtgcgcatgcgcgacacccggcaccgcgcccattcggcgcttcgacgcgtacgcagctccatgcgcggttctaggcgtggcgggccgcccggagacccgggctacgcggaaaccccctacgcgagcgtgtcccaccacgccgagatcgaccggtatggggattccgacggggacccgatctacgacgaagtggcccccgaccacgaggccgagctctacgcccgagtgcaacgccccgggcctgtgcccgacgccgagcccatttacgacaccgtggaggggtatgcgccaaggtccgcgggggagccggtgtacagcaccgttcggcgatggtagccgtttcgttcgttttaataaaccgacgttgtgcgtttcaccatacttcggcgcgcgtgtgtgtgtgtttttttttttgtggtgtttattttccccccaccccttccttttctttcggccaccacccccctcctcccccgtactatacaacaaaaaataccacacatacgaccaaatacggacaatcatttctgtctttattcgctatcagagagtgggggcgtgagcgtggcaggagggcgggccacgtcggggtcccgccgtctggtgtgacgcgatggggggtccgatgcgcgccggtactggggccccggcgcccgggtgaccacgcgcacgtcggggggcacgtagaagttaccctcttcttcggactcgatgtccacgacgtcaaattcgtgggcggtcagcgagacgacctccccgccgtcggtggtgatgacgttgtgtcggcagcagcagggccgcgccccggagaacgcgaggcccataacttggcgagcgtatcgtcgaaggccaggcggctgtttcgccggatgtcccggtagatccccggctcgacgcggacgggggtgatgatcagggcgatcggaacggcctggtccgggaggatcgatgccttggcgggtccgggggccccgccacgcccggcgggcgctccgcggccgtcctccaggcggaacgtcacgccctcctccgcgcccgcgcggtgcctgccgaggaacgtcaccaggtgcggttgcagggggcagtcgggaaagtggctgtcgaggacgtatccctgcaccaagatctgtttgaagttcgggtggcgggggttggcgaagatgggctcgcggcgaaccagctccccggagctccaggccacgggagagatggtgcgacgctcaaggtcggggacgccaaacagaagcacctccgagacaacgccgctatttaactccaccagcgcccgatccggggcggagcatcgccttttttcgccggcggcgcgggaatcgagccagtcccggtcttgggtgacgagcgcctcctccgggcccggaacgcgcccgggcgcgaagtagcgcacgccggggttggggatggaccggatgaacgcccggaacgcctccggcgatcgccgcgccatcaggtcctcgtacgcggaggccgcgggggcgccggggtccgcggggtcgaacgcgtacttggctcggcacttaacctcgtagaaggccaggggggtctggggggcgggggccaggtagccgtgagggtccctggggcacacgaggatgtccagggacgcccccaccatgcccgtgtggccgtccatgaggaccccgcacgcgtgcacgttctcctcggcgaggtccccgggttggtgaaagacgaagcgcccggcgtcggcgtcgtcgttgacgcccgcgtccgcgcggcccacgcagtagcgaaacagcaggtttcgggccgtcggctcgttcacccgcccgaacatcaccgccgacgactgggcgtccagccgcaggctggcgttgtgggtgagccactgggacgagaagcacggaccctgcgcgccccaccgcagcgtggaggcggtcgtcaggccccgccgaagcagggcccagagctggcagtcggcctggttttgcgtcgccgcctcgtaaaatcccataagcgggcggggggcgacggcttcggcggcggacgggggggcgcggcgcgtcaggcgccagaggtgccggccgagcccgcggtccaccatgccggccgcctccagcgacacgacgagggagcacagatagtccaggcgagcccacaggggcccgatggccagaggggagcggacgccgcgcagcaggccgcgcaggtggcgctcgaacgtttccgccaagatatgggggggcagtgcgttggggatcgccgacgccgaccacatcgggtcggggtccgggggaccggggctgcagtccgggtcgatggcgtgtgcgccccccggcgagaggggaatgtcgggggttggcgggccggatgaggcctcagagagggccggggacgcgggccgggccttttcgcccggggccccgccgtcgggttgcccacgtggggggctctggggccaatgggaacccggggcccccggtgacgtggggcggggtggggcggggcggggcccaaagacggtcgccagatctaggctgttgggtcggggccgcttcgggggactatcggggtcgcgggcggggtccgcggggcgcttggcgccgggtgttgcggcggccgccatttttacgagcagccgaagagctcgagggcggaagggatcctcacgacagagagtggcgcgcggccgggttggcgtgacagaggcgggagaccagcaccagcagcggcctcagctcgggcggcagcgacaccgacgacaggacggccttgtgcgtgcgctggtaatttatacactgctccgtgaacgcgcgccgaatcttgggattgcgaaggtggcgccggatgccctccggcacgtcatacgccaggccgtgggtgttggtctcggccgagttgacaaagagggcggggtgcagaacgcagcgataggcgaggagggccacggcaaagtccggcgagagctggttgttaaagtactggtagcccgggacgcgggtcacggggacgcccaggctcggggccacgtacacgctaaccagcagctccagcagcgtctgccccagggcgtagagatcgaccgccagcccgacgtcgtgcttcagggggcggttgttaaactcggcccgctcgttgttgaggtactttaccgagagctccggtggctggttgtacccgtgccccaccagagtgtgaaagttggccgtggtcagggcggcgggcatcccaaacccccggggggactcgaggtccggctcctggaggcaaaactggccccgggatatcgtggagttggagttcagggtcaccaggctaaagtcggccaggacggcccgccggagcgacaccgcgtccgatcgcagcatcacgaggacgttggcgcacttgatgtccaggtggctgatcccgcacctggtgttcaggaacaccacggcgcgcgccaggtctgtgaagcagtggtggagggccgtcgcgacggagggggtggtcgcgcgcagggacgccagctggccgatgtacttgccgaggtccatgtcgtacgcggggaacacgatctggcgctgctgcagcgagaacccgagcggggtgataaagccgcggatgtcgtgggtgcggccgccgcgaagagcgcactcccccacgagcagggtcgcgacgagctccacggcaaaccactctttttcccggatggtcttcacggcgagcttgtgttcgcgaatcaactgcacctcgccgtacccccccgagcccccgaagctgcgggccccggggatctccagggtcgtgtagcggagggcggggttgacggcgaatacggggatgcatagcttgtggatgcgcgcgagggacaggatgtgcgaggggggcgacgggggcgaggtcatggccgtctcggacctgcgcaggggcgggcgccttagcttggccgcagggccgggggcctcgggggacgagcggcgacgagacgagcggctcactcgccatcgggacagtcccgcgcgaagccgctcccggaagctggatcggcggcgggacccggggcgggctccggagacggcgccgtctcggggggaggggccgcttgggcgtccggacgcccggcggctgagggagtgtatgtaggacgcgagccaggccttgaaggagcgtcggtgtgcaccttgggggctgatgtcagctgccacatgactagcaggtcgctgtcgcccggactcatccatccgtccgccaggtcgccgtccccccacagagacgcgttcgccgcggcctcttcgagctgctcctcctggtccgcaagacgatcgtccgccgcgtccaggcgctcgctaagcgcgggatcgaggtaccgtcggtgtgcggttagaaaatcacgtcgcgccgcttgctcttccacgcgaattttaacacaggtcgctcgctgtcgcatcatctctaagcgcgcgcgggactttagccgcgcctccaattccaagtgggccgccttggcggccataaaggcgccaacaaacctaggatcttgtgtactcacgccctcccggtgtagctgcagggtctggtccctgtacacctcggcccggaggtgcgtctcggccaaacgtcggcgcagggccgcgtggctggcgtctcggctcatctcgccgcccccgcgcgcgcccgacgtcggactccttcgccccgacccccctgacctcagccgcccccgcctcgcccgcgatgtttggccagcagctggcgtccgacgtgcagcagtacctggagcgcctggagaaacagaggcaacagaaggtgggcgtcgacgaggcgtcggcgggcctgacgctcggcggcgatgcgctgcgcgtcccttttttggattttgccaccgcgacgcccaagcgccaccagaccgtggtcccgggcgtcgggacgctccacgactgctgcgagcactcgccgctcttctcggccgtcgcgcggcggttgctgtttaatagcctggtgccggcgcaactcagggggcgtgactttgggggcgaccacacggccaagctggagttcctggcccccgagctggtgcgggcggtggcgcgcctgcggtttcgggagtgcgcgccggaggacgccgtgccccaacgcaacgcctactacagcgtcctgaacacgtttcaggccctgcaccgctccgaagcctttcggcagttggttcacttcgtgcgggacttcgcccagttgttgaaaacctcgttccgggcctctagtctcgcggagactacgggccccccgaagaaacgggccaaggtggacgtggccacccacgggcagacgtacggcaccttggagctcttccagaaaatgatactaatgcacgcgacctactttctggccgccgtgctgctcggggaccacgcggagcaggtcaacacgttcctgcggctcgtgttcgagatccccctgtttagcgacacggccgtgcggcacttccgccagcgcgccaccgtgtttctagtccccaggcgccacggaaagacctggtttttggtgcccctcatcgcgctgtcgctcgcgtccttccgggggatcaagataggctacacggcccacatccgcaaggcgaccgagcccgtgtttgatgagatcgacgcctgcctgcggggctggtttggctcgtcccgggtggaccacgtcaagggggaaaccatctcgttctcgttcccggacggctcgcgcagcacgatcgtgtttgcctccagccacaacacgaacgtaagtacgccttcctcccgcggtgcctgtttccccggtgccgccctccccgagatcgaccgacagacaaacacagccagacgcgagtgtgggacgacacgcccgcagccccccccccgccatggcgggggggaagccttactgtttatttgtaatcggacgatgaggctctggccacggcccgcgcgaccgcggggcagctcgttgcaaacaggcggctggtatacgatgacagaacgcagaggcgccacccggcgctggtcgggcggatgacgctttccgcgccgtcccggcccacgacgacctcgtgcaggtgggccgtgatgcgcgggcggcgggtcgcctgccgcaggataaccgcgtccacggggtgcccgaagaggagctgacacaggctcgcgtccccccggacggccagggtgcgctgggccatattggaccacatgcacggggcgacgcagggacaggcctccgccacggcgggggcgcgccacagcgcgttggcggaatcgatgtgggccgtcggggcgcaggcgccgcctcctcccggggggtcggtaatcctggatagcagccatcctaaatggcgggcccggctgcccgggggacagagcgaccccaggtcatcatccatggcccagcagtatatgcggccgccggggaggtgccaccaggcccccggacccagggcacagcacgcccccggattcgggggcggttccgtgggtaccaggtaggcgccgtcgagctcgtgggccacgggctcgtccgcgagctgttcggcggcggggtcgggggtttcctccgggggggaggcagcttccaggtggccgaaggctagggtgcacagcagcggggtccgggggtgcgttacgctgcggaggtggacggtggcgcagtagcggcgctcgcggttaaagaagaaaatggcaaagaacgtgttcgaaggcaggcgcagcgccttgggccgcgtcaggtacaggaagatctcgcagaaaagggcacgctcggggtcggggtccggaagggccacctggcacagcggctcggtgaggaccgtgaggcaccgaaaaatcttaagccgctcgtccccccgaacgacgcgccacacgaagacagagttggcgatgcgcgcgacgaggtcggcttcgggccccgggtcgggggcgcgcgcgtcggggggggcgccccggtgacccggcggggccgcggctcccggggggcctggcgtcgcctggggacgccagagtgcccgctgtgccaggttggtggtggggaagggaccggagacgcaccaaaagcagaggggccagcgcgtgtatgagttggggggggggtgggtgagcggtggaacaaaagcacgcgtcagcggacaaggccgggtcccgtagccgccccgcgacagaaccggagtccgacggcacgcgcgacggggtctgcgaggctgaggtacgccgcggtgttaatggtaaacgcaaagcctcccggaaagaccactagcccgcagaggcggcgattgaacccaaggcagaggtacgcgtagctctctcccggaaggtattgctcgcagaccctgtgtggggcagtggaggggctgccctccatgaagcgacatttactctgctcgcgtccattgacgtcaccgtcaatcaccactgcgattggacggttggtgaggcgcagcgtgtctccgctggtgctgtagtagtcaaacgcgtagtgggcgtcggagtcggcgaagcgggcggggatgtcgtcgctgagagggacgagccgccgccgccgcccccgaccgccctggccgcccagatgcgccagcacggccagggcgtacgcggtgtgaaagaacgcgtcgggggcggtcccctcgagggcgcgcatcaggttctccaggagcacggggaagcgccgcgtcacctcccctagccactcgctctggtgggggccaaagtcgtagcgcaggcgctggaagatgcgcgggccgccttggagcgcggcccggatagagtggcccagggcccgcagacacgcgatctggatgcgcgcgacgaaggccacctcggccgcgatgtcaaagggctgcagcacggggcgcgggtggcgcaggggtccctcgagcgcgggaaagcgacgcagcagcgccgtctgggccgcgggggacagctggtgggggcgcacgacgcgctcggcggcacaggcctccgtcagggccgtggccagctcggaggacagccgcggggggcgggcgcgtcgcccgccccacgccaccgaattctcgtaggagacgacgacgaagcgctgcttggtcccgtagtgatggcgcaggaccacggagatggagcgacggctccacagccagtcgggccggtcgccgccggccagagcttcccacccgcggtccagccactcgaccagcgatcgcggcttggcggtccccggcacgagggtgagcacgtcgttgaggacgtcctcgcccgcggcccgggggccccccggggtggcaaagcgccccccgccgggcggctccaggcccgccagcaccgcctccgcgtccgacgcgcccagggctcccccgctgacggcctggtggaccagggcgccctggcggagccccgaggcgacgccggaggccgcgtgcttggggcgcgcgcggaccgggtggcggcgggtgacgtcctgcacggcccgctggaccagcgcgaggatctcctcgttctcttgcgtgatggacacgtcctccgcggtggccgtgtcgcctcccggggccgtgagctgctcctccggggagatgggggggtctggggtgccgacaacggccggcccggccccgcccgagaccgaggacgcctggggagtgggggtgccgctttcccccatccccagggacaggtgggccgccgcctccgtcgcggcggcgggagccgcggcccccagccgcgcgacgtagcgacaaaagtggcgacagaggcgcatgaggcgcgcgccgtcggccgcgtatcgcgtgtttggcgggacgagctcgtcgtaactgaacaggagcacgcgggcgcaggtcgcccacgggccccacgccaggcgcagcgccgcgaccgtgtacgggtcgtacacgccttgggcgtcgcacgcgaccggcagggagacgaacagcccgcccgcgctggggacgcgcggcaggaggtccgggtgcgccgggatgacgggggctaggatcgcccccaccgcatccgccggcacgtaggcggcaaacgccgaacgccacggggtgcagtcgccggtcgcgtgggcccgggtctgggtttcgacccggaagttcgcggccgccccaccgtcggggcggccgcgcacgagggcggacagcgggacccccgccgccgccaggcactcgctggagatgatgacgtgaatcagcgaggcggggctgctcgggtcccgggtgagatcgtattggacctcgttggcaaagtgcgcgttcatggcccggccggcggtgcgagcccttcccggtgccggaaggggcgtgggtggggggtgcgtgtgcgcgtcctcggggcccgcgggcgcacgtgcgcttatacgctgtgtgtttcgtctgtccccagggaatccggggccaggactttaacctgcttttcgtcgacgaggccaactttattcgcccggatgcggtccagacgattatgggctttctcaatcaggccaactgcaagatcatcttcgtctcgtcgaccaacaccgggaaggccagcacgagctttttgtacaacctccgcggggccgccgacgagctgctcaacgtggtcacctatatatgcgacgaccacatgccgcgggtggtgacgcacaccaacgccacggcctgttcctgctatatcctgaacaaacccgtgtttatcacgatggacggcgccgttcgccggacggccgatctgtttctgcccgactccttcatgcaggagatcatcggggggcaggcccgcgagaccggcgacgaccggcccgtcctaacaaagtcggcgggggagcggtttctgctgtaccgcccctccaccaccaccaacagcggcctgatggcccccgagctgtacgtgtacgtggacccggcgttcacggccaacacgcgcgcctccggcaccggcatcgcggtcgtcgggaggtaccgcgacgatttcattatcttcgccctggagcactttttcctccgcgcgctcacgggatcggcccccgcggacatcgcccgctgcgtcgtgcacagcctcgcccaggtgctggcgctgcaccccggggcgtttcgcagcgttcgcgtggcggtcgagggcaacagcagccaggactcggccgtggccatcgccacacacgtgcataccgagatgcaccgcatcctggcctcggcgggggccaacggcccggggcccgagctcctcttctatcactgcgagccgcccggcggcgcggtattgtaccccttctttctgctcaacaaacagaagacgcccgccttcgaatactttatcaaaaagttcaactccgggggcgtcatggcgtcccaggagctcgtctccgtgacggtgcgcctgcagaccgacccggtcgagtatctgtccgagcagctcaacaacctcatcgaaaccgtctctcccaacaccgacgtccgcatgtactccggaaaacgcaacggtgccgcggacgacctcatggtcgcggtcatcatggccatttacctggcggccccgaccgggatccccccggccttttttccgatcacgcgcacgtcttgagtctttcttgccgtttcttttgtttctctttctttccccccctctctccgcaataaacgccttcccggaactgtgtttccccccctacaacagtgttgtccgttggttgggtggttggggtgcgggggtgggcgggggaagcaagaaaacggtcggcgaacacaacatcgggaaaacggattcccgcacgtgcgtcttcccagattcgacacacacaccccccttctccttaaataaacacaaaccacacgctcgttggttggttaatgccagcgctttatttacgtcttgttttttttgcgtttcctccgcgggtcccttcccaacacgcctgcccccgcctcaggggtagcggataaccggggccatgtcgccggattgcacaacggcggcgccgtcgaacgtacacacccgaaccgccggggccagggccaggatgtccccgagttggcccgcgtgcgccagccaggcgaccagcgcctcgtaaagcggcagcctgcgttcgccgtcctgcatcagcatgggggcttcggggtggatgagctgggcggcttctcgcgtgacgctctgcatctgcaggagcgcgttcacgtatccgtcctgggcgctcagcgcgagcagccgggggatgagcgtgaggatgagggtggttccttcggttatggagtagaccatgttgaggacgagcgaccgcagctcggtgtttacggaggcgagttgctggacgtcggccacgagcgagagacgggccccgttgtaatacagcacgttgaggtcggggagctccccgggcgtccgggggtcggggttgaggtcccggatgccccgggcgaccagccgcgcgactatctcgcgggccaggggcgttgggagcgggaccggaaaccgcagcgtgaggtccagcgactccaggcgcacgtccgtcgcctggccctcgaagacgggcgggacgaggctgacgggatccccgttgcagaggtcgacgggggaggtgttgcggagattgacggtgccggcgtgcgtgagccccaggtccacggggcaggcgacgattcgcgtgggcagcacccgcgtgattaccgcggggaagcgcctgcggtacgccagcaacaaccccaacgtgtcgggactaactcctccggagacgaacgattcgtgcgccacgtccgcgagcgccagctggcggcggatggtcggcagaaagaccactcgaccctcgcaccgctgcagcgccgcggcatcggggcgcgagatacccgaggggatcgcgatgtctgcttcgaaacaatccgtgatcatggcgccgggccgcgagacaccggaacgcgggggtgcgggagggccggaaagcgcaacgcaaccgggacgatgatgaaacagagatggggggcaccgaccgtgtgggagagggggcggggcagggctcagcagcacgcacggggaggtctgtcgtgcgcaggagccccaggtgagaatcagtcccccggagctcgggtctgggttttattgggacctgccctcggaatcgcggctcccagtccaagcccccctggggggggcggggacagggggtgtgtgtgggtaaaagcaacgtcggaaaatcaaacccaatgccccaaacaggaaaaaaaaagacgggcgggtggagggaaagctggggaagaagaagccaattttacagagacaggccctttagcggggaggcgtcgtagatgagatactgcgtaaagtgggtctctcgcgcgtgggcctccccatcgcgggcgctgcgtagcagggcggggtcgctggcgcaggtgatcgggtaggcttcctgaaacaggccgcacgggtcttccacgagctcgcggcaccccggcgggcgcttaaactgcacgtcgctggcagcggtggccgtggataccgccgatcccgtttccacgataagacgctccaggcagcgatgtttggccgtgatgtcggccgcggtgaagaacttgaagcaggggctgaggacgggcgaggccccgttgaggtgataggccccgttgtacagcaggtccccgtacgagaaccgctgcgacgcccacgggttggccgtggccgcgaagggccgcgccgggtcgctctggccgtggtcgtacatgagggctatgacgtccccctccttgtcccccgcgtacacgccgccggccgcgcgtccccgcgggttgcagggccggcgaaagtagttgatgtccgtggccacgggggtggcgatgaactcacacacggcatcctgcccgtggtccatgccggcgcgccgcggcacctgggcgcagccaaagaccgggaggggctgggccggccccagccggtttcccgccacgaccgcgttgcgcaggtacacggcggccgcgttgtctagcagcgggggggccccgcggccgaggtaaaagttttgggggaggttgcccatgtccgtaacggggttgcggacggtggccgtggccgcgacggcggtgtagcccacacccaggtccacgtttccgcgcggctgggtgagcgtgaagttgacccccccgcccgtttcgtggcgggccacctggagctggcccagaaagtacgcctccgacgcgcgctcggaaaacagcacgttctcggtcacgaagcggtcctgccgcacgacggtgaacccgaacccggggtggaggcccgtcttgagctggtgatacagggccacggggctcatcttgaagtaccccgccatgagcgcgtaggtcagcgcgttctcccccgccgcgctctcgcgggcgtgctgcaccacgggctggcggatggaggagaagtagttggcccccagggccggggggaccagggggacgtggcgcgccaggtcgcgcagggccggggggaagttgggcgcgttggccacgtggtcggcgcccgcaaacagcgcgtggacgggcaggacgtagaagtattcgccattttggatggtgtggtccaggtgctggggggccatgagcagcacgccggcgtgcagcgccccgtcgaagatgcgcatgttggccgtcgacgcggtgttggcgcccgcgtcgggcgccgcggagcacagcagcgccgtcgtgcgctcggccatgttgtgcgccagcacctgcagcgtgagcatggcgggcccgtcgacgacgacgcgcccgttgtggaacatggcgttgaccgtgttggccaccagattggcgggatgcagcgggtgggcggggtcggtcacgggatcgctcgggcactcctcaccgggggcgatctccgggaccaccatgttctgcagcgtggcgtacacgcggtcgaagcggacccccgcggtgcagcagcgcccccgcgagaaggccggcaccagcacgtaatagtagattttgtggtggacggtccagtcggccggccggtgcggccggtcgtcggcggcgtcggccgcgcgggcctgggtgttgtgcagcagccggccgtcgttgcggttaaagtcggccgtcgccacgttgcacgccgccgcgtagacgggctcgtgcccccccgcgtcaatccggcagtctcggtggcggtccagggccgcgtgtcgcataaggccgtcgcagtcccacacgaggggcggcagcagcgccgggtcgcgcatcaggtgattcagctcggcctgagcctgcccgcccagctccgggcccggcagggtaaagtcgtccaccagctgggccagggcctcgacgtgggccaccaggtcccgatacacggccatgcactcctcggggaggtcgcccccgaggtaggtcacgatgtacgagaccagcgagtagtcgttcacgaacgccgcgcatcgcgtgttgttccagtagctggtgatgcactgagtcacgagccgcgccagggcgcagaacacgtgctcgctgccgtgaatcgcggcttgcagcaggtaaaacaccgccgggtagctgcggtcctcgaacgccccgcggacggcggctatggtagccggcgccatggcgtggcggccaacgccgagctccaggccccgggcgtcacgaaacgccaccggacacagcgccaggggcaggttgccgttgaccacgcgccaggtggcctggatcgcccccggaccggccggggggacttcgccgccgggaagctcgacgtcggccacgcccgcgaagaagtcgaacgcggggtgcagctccagagccaggttggcgttgtcgggctgcatgaactgctccgcggtcatctggcactcggcgacccaccggacccggccgtgggcgaggcgctgccgccaggcgttcagaaaacgctgctgcatgtccgcgccggggccggccggggccgcgacgtacgccccgtacggattcgcggcctcgacggggtcgtggttcacgcccccgacggccgcgtcgatgttcatgagcgaaggatgacacacggtcccgaccgcgttctccatggacagccgcagaacctggtggtcctttccccaaaaaaacagctgccggggagggaacgcgcggggctccgggtggccgggggcgggcaccaggtccccggcgtgcgcggcgaagcgctccatggccgggttgaacagccccaggggcaggacgaacgtcaggtccatggcgcccaccagggggtagggcacgttggtggcggcgtagatgcgcttctccagggcctccaggaagaccagcctgtcgcctatggccaccagatccgcgcgcacgcgcgttgtctggggggcgctttcgagttcatccagcgtctcccggttcgcctcgagttgctcctcctgcatatccagcaggtggcggcccacgtcgtccaggctccgcacggccttgcccatcaccagcgccgtgacgaggttggccccgttcaagaccatctcgccgtaggtcaccggcacgtcggcctcggtgtcctccaccttcaggaaggactgcaggaggcgctgtttgatggcggcggtggtgaccagcaccccgtcgaccggccgcccgcgcgtgtcggcgtgcgtcaggcggggcacggccacggacggctgcgtcgccgtggtcaggtccacgagccaggcctcgatggcctcgcggcgatggcccgccttgcccaggaagaagctcgtgtcgcaaaagctccgcttcagctcggcgaccagggtcgcccgggcaaccctggtcgccaggcgcccgttgtcgagatatcgttgcatgggcaacagcagggccaggggaggcgccttctccaacagcacgtgcagcatctggtcggccgtgccgcgctcaaacgcccccaggacggcctggacgttgcgcgcgagctgctggatggcgcgcagctggcgatgcaggctaatgcccgtcccgtccagggcctcccccgtgagcagggcaatggcctcggtggccaggctgaaggcggcgttcagggcccggcggtcgatgaccttcgtcatgtaattatgcacgggctgctcgacggggtgcgggccgtcgcgggcgatgaggggctggtggacctcgaactgcacacgcccttcgttcatgtaagccagctccgggaacttggtgcacacgcacgccacggacaggccgagctccagaaagcgcacgagcgacagggtgttgcagtaggaccccagcagggcgtcaaactctacgtcatacaggctgttttcgtcggagcgcacgcgggcgaaaaaatcaaagagtctgcggtgggacgccacctcgatcgtactcaggatggagccggtgggcaccatggccgcggcgtaccggtaacccggggggtcgcgggcaggagcggccattgggttccttgggggattcgcaggctccatcaagccgagctcgggaaggccaagcccctcccgcacaacgcctcaccgccggcggacgcgactaacaacccacgggccgccaaaaccccaaggggcaacccgaccaacaacaggcgaggggaggaaaggcgtaaagggggcgttgggaggcaaaaagaaagaaaacacccagacgtaggcccgaggaccggccggcgtcctctgtccccgagcacccactgtgcccaacaggcacgggggcgagctgcccctgccttatatacccccccgccacacccccgttagaacgcgacgggtgccttcaagatggccctggtccaaaagcgtgctagaaaaaagttggtaaaggcggcaaagcagtccgccgccgccacccacatggcggcgccggccgcgcaggcgattcccagagaacgggcgcggaggggatccgtgcggggcagcagctggctggcggtgatccaatggaaaagcccgtcgggactgaacgtctcatgggcggccgccaccagggcgcacagggccgcgccgcccatgatcacgcacaacccccaaaacacgggtggcgacaacggcaggcgatcccgtttgatgttcacgtacaggaggagcgcccgtgccagccacgtgacatagtaggcgaggacggcggctataatacatgccggcgccaccgcccgtccggtccacccgtaatacatgcccgcggccaccagctccagcggcttgaggaccaggaacgaccaagcaaacatcaccacccgcttggaaaagaccggctgggtgtggggcggaagacgcgagtaggccgaactgacaaaaaaatcagacgtgccgtacgaggacagcgaaaactgttcatcgagcggcagttctccgtcctccccgccacacgcggcctcgtctaccagctcgcgatccaacaaaggaacatcatcccgcattgtcatggtcggtgcggggagccggcgaggcagcaaaaccgaaagtagtgctggcggcgcgggcccgggtccggacccaagcttcagggatggggggcggaggccaaaatcaaacaagcaccgcgcgggttctacacacaacccccacccgggtagtatccgcggatgcgagtgcctggcgaagtcacgtcccagcaggatataaacctcggccgttgggcccggaacccccgaaattcacacccacgccctgacgcccaaatcatgggtggatgtggttcgcgagccgcacatccgtgcgtccgccctcccccgcgggctgatgacgtggcggttagtcagtgggaaggcagggggaaagatgggttgggggaggaaacgaagaaaacacccagagggccacgtcgggaatgcgcccggagttgtccttaaaaggccggccgtgcgtgacggaagccgtcgtttgcccaagcaccgacgccgcgatccacagtggggggagttcctccgtccggccacaaccctacgcgcgggcggcacgcgcgagagcaacccacgggtcccgttcgcgccaccgccagcccttgctcccaccaccctcctcccaccaccccactattcccccccccaagtccgccccgtggctcgccggccatggagctcagctatgccaccaccctgcaccaccgggacgttgtgttttacgtcacggcagacagaaaccgcgcctactttgtgtgcggggggtccgtttattccgtagggcggcctcgggattctcagccgggggaaattgccaagtttggcctggtggtccgggggacaggccccaaagaccgcatggtcgccaactacgtacgaagcgagctccgccagcgcggcctgcgggacgtgcggcccgtgggggaggacgaggtgttcctggacagcgtgtgtctgctaaacccgaacgtgagctccgagcgagacgtgattaataccaacgacgttgaagtgctggacgaatgcctggccgaatactgcacctcgctgcgaaccagcccgggggtgctggtgaccggggtgcgcgtgcgcgcgcgagacagggtcatcgagctatttgagcacccggcgatcgtcaacatttcctcgcgcttcgcgtacaccccctccccctacgtattcgccctggcccaggcgcacctcccccggctcccgagctcgctggagcccctggtgagcggcctgtttgacggcattcccgccccgcgccagcccctggacgcccgcgaccggcgcacggatgtcgtgatcacgggcacccgcgcccccagaccgatggccgggaccggggccgggggcgcgggggccaagcgggccaccgtcagcgagttcgtgcaagtgaagcacatcgaccgtgttgtgtccccgagcgtctcttccgcccccccgccgagcgcccccgacgcgagtctgccgcccccggggctccaggaggccgccccgccgggccccccgctcagggagctgtggtgggtgttctacgccggcgaccgggcgctggaggagccccacgccgagtcgggattgacgcgcgaggaggtccgcgccgtgcatgggttccgggagcaggcgtggaagctgtttgggtcggtgggggctccgcgggcgtttctcggggccgcgctggccctgagcccgacccaaaagctcgccgtctactactatctcatccaccgggagcggcgcatgtcccccttccccgcgctcgtgcggctcgtcggtcggtacatccagcgccacggcctgtacgttcccgcgcccgacgaaccgacgttggccgatgccatgaacgggctgttccgcgacgcgctggcggccgggaccgtggccgagcagctcctcatgttcgacctcctcccgcccaaggacgtgccggtggggagcgacgcgcgggccgacagcgccgccctgctgcgctttgtggactcgcaacgcctgaccccgggggggtccgtctcgcccgagcacgtcatgtacctcggcgcgttcctgggcgtgttgtacgccggccacggacgcctggccgcggccacgcataccgcgcgcctgacgggcgtgacgtccctggtcctgaccgtgggggacgtcgaccggatgtccgcgtttgaccgcgggccggcgggggcggctggccgcacgcgaaccgccgggtacctggacgcgctgcttaccgtttgcctggctcgcgcccagcacggccagtctgtgtgagatatcccaataaagtgcagtcgttttctaacccacggatgccgttgtatgcctatacgggggactatggggggggaaaggaaaggaaacaggaatggagaagggaaaggaacagaggcggtagcggacgcacggcggacacaataacaaacagaccgcggacacggagggagtcggttgggttgggcgtggacgccgctgcgtccacacacccgtttattcgcgtctccacaaaaatgggacgcacgttcggaccaccctaaggatgcccgccagggccgcggtaatcataacgacccccagcgcggacgcggccagaaacccgggggcgatggtggcgatgggcagcgtgtcaaaggccagcagatgaatcacagttccgttggggaacaacaacagggccacggacggcacgtcgctggaaaacacgttcggggtgcccgccaccggcccctgggccagctgctgttgggtggcatccgtgtccaccagcagcaccgacatgacctccccggccggggtgtagcgcagaaacacggcccccacgaggccgaggtcgcgccggttttcggtgcgcaccagccgcttcggctcaatctcccgcgcgtgcccttcgcaggtggcggtgagataggtgataaacagcgggcggcggacgtcaacgcccgtaagcttgtatccgatcccgcggggcaagggggtgtgggtgacgacgtagctggcgttgtgggtgatgggcacgaggatccggggctccgcgttgtgcgacgggccgctacactggtgggtggcctccgggacgaaggcgcggatcagggcgttgtagtgcgcccagcgcgtgagaacggaggccacgccgcgggtctgttgtgccatgacgtccgccgggatgtcggatcgggtggccatggccagcgcgtccaggatgaacccgccctcggcgagatcgaagcgcagggaagctgcgcatggggaaaagtggtccgggagccagaagaggtttttctggtggtcggtcctggctagcgcggcccggagatcggcgtgggtcgccgcggcgacgtcggacgtacacagggccgtggttatgaggaggccccggcgggcgcgttcccgctgctcggccgagggcgcgcccgccaggaacggcgcccggaggacggccgtggcgtaaaacagcgctcggcggaccatcggggcggttagcgcgcggccgccgagaaactcggcgtacagggcgtcgatcaggcgggccgcgctcggggccaccgcgccataggccgcggggctgtccaacacgaacgccagctgatagcccagcgcgtgcgccgccaggctctgctctcgctcgaggatcgcggccaccagatgcccgaggcgcgcctccagccgcaggcgggccgccgggtccaacacggacacgttcaggaacaccgagtcggccgcgcagcccgctgctccccgggcggccaggccggccagcacgcgcgagtgggccaaaaagcccagcaggtcggagaggcgaatcgcgtcgtgggcgtgggccgcgttgacgaacgcaaaccccgacgaggcgagcagccccgcgaggcgccagaacagggacggacgcgcgtccgtgccggagcccgggtcctcccccaaaaactccgcataggcccgcgacatatactgggcgtagttcgtgctctcctcggggtagccggccacccgccggagggcgtccagcgccgagccgttgtcggcgggcgtcggggcccccaggacaaagacgcgatacctggggccggccggaggcccggggagcaccgcgggggcgttttcgtcggtcggatttccgacccgagcgagggtcttgtccgcaggcaccactatgatctcggccggagggctgtcccgcatcgatatcacgagccccatgaagcccttcccgtatcgcgcgcgcacgagcgcggcgtcgcacccgaacgccagcccgcccgtcgtccagacgcccacgggccacgtcgaggccgacggggagaggtacacgtaccgacccggagtccgtagcaggcccctggcggccagccaggtcacggatgcgttgtgcagatgcgcgatgctcaggttcgtcgtcggatgcctcggtgtccccgcgggcggccccgggggcggcgcgttgcgtcggccgtccgggtgcctctcggtcgccccgtcgtctccccgcgggaacgtaagcccctcgcggtccggcgcggccgcgaatgttacccaggcccgggaccgcaacagcgcggaggcgccggggttgtgcgacagtcccttgagctgggtcacctcggcggggggacgggacgtgggccccgcctcggggagctcgggcaggctcgcgttccgaggccggccgagcagataggtctttgggatgtaaagcagctgcccggggtcccgaggaaactcggccgtggtgaccaacacgaaacaaaagcgctcggcgtaccaccgaagcatgggcacggatgccgtagtcaggttgagttcgcccgggggcgccaagcgtccgcgctgggggtcgctggcgtcgggggtgttgggcaaccacagacgcccggtgtttgtgtcgcgccagtacgtgcgggccaaccccagaccgtgcaaaaaccacgggtcgatttgctccgtccagtacgtgtcatggcccccggcaacgcccaccaggacccccatcaccacccacagaccggggcccatggtcgtccgtcccggctgccagtccgcagatgggggggggtgtccgtacccacggcccaaagaggctccgcacctcggaggctatcggaggccctttgttgccgtaagcgcgggccaaaggatggggtggggtgagggtaaaagcacaaagggagtaccagaccgaaaacaaggacggatcggcccgctccgtttttcggtggggtgctgatacggtgccagccctggccccgaacccccgcgcttatggacacaccacacgacaacaatgccttttattctgttcttttattgccgtcatcgccgggaggccttccgttcgggcttccgtgtttgaactaaactccccccacctcgcgggcaaacgtgcgcgccaggtcgcgtatctcggcgatggacccggcggttgtgacgcgggttgggatcatcccggcggtgaggcgcaacagggcgtctcgacacccgacgggcgactgatcgtaatccaggacaaatagatgcatcggaaggaggcggtcggccaagacgtccaagacccaggcaaaaatgtggtacaagtccccgttgggggccagcagctcgggaacgcggaacagggcaaacagcgtgtcctcgatgcggggcagagaccccgcgccgtcctcggggtcggggcgcggggtcgccgcggcgacccccgtcagccggccccagtcctcccgccacctcccgccgcgctgcaggtaccgcaccgtgttggcgagtagatcgtagacacggcgaatggcggacagcatggccaggtcaagccgctcgcccgggcgttggcgtctggccaggcggtcggcgtgttcggcctccggaaggacacccaggaccaggttcgtgccgggcgcggtcgggggcatgagggccacgaacgccaacacggcctggggggtcatgcttcccatgaggtaccgcgcggccgggtagcacagcagggaggcgatagggtgccggtcgaaaacaagggtgagggccgggggcggggcttgcgggcccacagcctcccccccgatatgaggagccaaaacggcgtccgtcgccgcataaggcgtgctcattgttatctgggcgctggtcattaccaccgccgcctccccggccgatatctcgccgcggtccagacggtgctgcgtgttgtagatgttcgtcagggtctcggaggcccccagcacctgccagtaagtcatcggctcggggacgtagacgatattgtcgcgcggccccagggcctccatcagctgcgcggaggtggtggtcttccccaccccgtggggtccgtctatataaacccgcagcagcgtgggcagctccggatccccgcgggctccggaggccccctggcgatggctaggacgggacgccgcgcggccgtcggtaggcccgctcgcacgagcagcctgaccgaacgcaggcgcgtgctgttggccggcgtgagaagccatacccgcttctacaaggcgttcgcccgagaggtgcgggagttcaacgccaccaggatttgtggaacgctgctgacgctgatgagcgggtcgctgcagggtcgctcgctgttcgaggccacgcgcgtcaccttaatatgcgaagtggacctcgggccgcgccgcccagactgcatctgcgtgttcgaattcgccaatgacaaaacgttgggaggtgtgtgcgtcatcctggagctaaagacatgcaaatcgatttcttccggggacacggccagcaaacgcgaacagcggaccacgggcatgaagcagctgcgccactccctgaagctgctgcagtcgctcgcgcctccgggggacaaggtcgtctacctgtgtcctattttggtgtttgtcgcgcagcgtacgctgcgcgtcagccgcgtgacccggctcgtcccgcaaaagatctccggcaacatcaccgcggccgtgcggatgctccaaagcctgtccacgtatgccgtgccgccggaaccgcagacccggcggtcgcggcgccgggtcgccgcgaccgccagaccgcaaaggcccccctccccgacacgtgacccggaaggcacggcgggtcatccggccccaccagagagcgaccccccctccccaggggtcgtaggcgtcgctgcggagggtgggggtgtgcttcagaaaatcgcggcgcttttttgcgtgccggtggccgccaagagcagaccccggaccaaaaccgagtgaggttctgtgtgttgtttttttttttttttcctcgttttgttttctcttctttcccccccccctcccccgcttctggccaagcatcctcacctgcttaagcggaacccgcgggcgcgcggggactcatttgtcgccggcgacacccacccgacaacagcccctgggtgtcgaccgctgtcgcccccgtctgtcgcctctcccttttttccccccctcaaagaacgtggtgttgggcgccggccaattcttcccggagcgccgtcgtcgcccgcccgccgccctcgaacatggacccgtactaccctttcgacgcgctggacgtttgggaacacaggcgcttcatcgtcgccgactccaggagcttcatcacccccgagttcccccgggacttctggatgttgcccgtgttcaacatcccccgggagacggcggcggagcgggcggcagtgctgcaggcccagcgcaccgcggccgcggcggccctggagaacgccgccctccaggccgccgagctgcccgtcgacatcgagcgccggatacgcccgatcgagcagcaggtgcatcacatcgccgacgccctggaggcgctggagaccgcggcggccgcggccgaagaggcggatgccgcgcgggacgccgaggcgaggggggagggcgctgcggacggggcagcgccgtcgcccaccgcgggccccgccgccgcggagatggaggttcagatcgtacgcaacgacccgccgctacgatacgataccaacctccccgtggatctgctacacatggtgtacgcgggccgcggggccgcgggttcgtcgggagtcgtctttggtacctggtaccgcacgatccaggaacgcaccatcgcggacttccccctgaccacccgcagcgccgactttcgagacgggcgcatgtccaagaccttcatgaccgcgctggtcctgtctctgcagtcgtgcggccggctgtacgtgggccagcgccactattccgccttcgagtgcgccgtgctgtgtctgtatctgctgtaccgaaccacccacgagtcctcccccgatcgcgatcgcgctcccgttgcgttcggggacctgctggcccgcctgccgcgctacctggcgcgtctggccgcggtaatcggcgacgagagcggacgcccgcagtaccgctaccgcgacgacaagctgcccaaagcgcagttcgcggcggccggcggccgctacgagcacggggccctggccacccacgtcgtgatcgccacgttggtgcgccacggggtgctaccggcggccccgggcgacgttccccgagacaccagcacccgcgtgaaccccgacgacgtggcccaccgcgacgacgtcaaccgcgccgccgccgcgtttttggcacgcggccacaacctcttcctgtgggaggaccagacgctgctgcgggcgaccgccaacaccattacggccctggccgtgcttcggcggctcctcgcgaacggcaacgtgtacgcggaccgcctcgacaaccgcctgcagctgggcatgctgatcccgggagccgtcccggcggaggccatcgctcggggggcgtccggattggactcgggcgccataaaaagcggcgacaacaacctggaggcgctgtgcgttaactatgtacttccgctgtatcaggcagaccccacggtcgagctgacccagttgtttccggggctggccgccctgtgcctggacgcccaggcggggcggccactggcgtcgacgaggcgcgtggtggatatgtcgtcgggcgcccgccaggcggcgctcgtgcgcctcaccgcgctggagctcatcaaccgcacccgcacaaacaccacccctgtgggggagattattaacgcccacgatgccttggggatacaatacgaacagggcctggggctgctcgcccagcaggcacgcatcggcttggcgtcaaacaccaagcgattcgccacgttcaacgtgggcagcgactacgacctgttgtactttttgtgtctcgggttcattccccagtacctgtccgtggcctagggaagggtgggggtggtggtggtggggtgtttttctgttgttgtttctggtccgcctggtcacaaaaggcacggcgccccgaaacgcgggctttagtcccggcccggacgtcggcggacacgcaacaacggcgggccccgtgggtgggtaagttggttcgggggcatcgctgtattcccttgcccgcttccacccccccccccttcccgttttgtttgtttgtgcgggtgcccatggcgtcggcggaaatgcgcgagcggttggaggcgcctctgcccgaccgggcggtgcccatctacgtggccgggtttttggccctgtacgacagcggggacccgggcgagctggccctggacccagacacggtgcgtgcggccctgcctccggagaaccccctgccgatcaacgtagaccaccgcgctcggtgcgaggtgggccgggtgctcgccgtggtcaacgaccctcgggggccgttttttgtggggctgatcgcgtgcgtgcagctggagcgcgtcctcgagacggccgccagcgccgctatttttgagcgccgcggacccgcgctctcccgggaggagcgtctgctgtacctgatcaccaactacctgccatcggtctcgctgtccacaaaacgccggggggacgaggttccgcccgaccgcaccctgtttgcgcacgtggccctgtgcgccatcgggcggcgccttggaaccatcgtcacctacgacaccagcctagacgcggccatcgctccgtttcgccacctggacccggcgacgcgcgagggggtgcgacgcgaggccgccgaggccgagctcgcgctggccgggcgcacctgggcccccggcgtggaggcgctcacacacacgctgctctccaccgccgtcaacaacatgatgctgcgtgaccgctggagccttgtggccgagcggcggcggcaggccgggatcgccggacacacgtaccttcaggcgagcgaaaaatttaaaatatggggggcggagtctgcccctgcgccggagcgcgggtataaaaccggcgccccgggtgccatggacacatcccccgccgcgagcgttcccgcgccgcaggtcgccgtccgtgcgcgtcaagtcgcgtcgtcgtcttcttcttcttcttttccggcaccggccgatatgaaccccgtttcggcatcgggcgccccggcccctccgccgcccggcgacgggagttatttgtggatccccgcctctcattacaatcagctcgtcaccgggcaatccgcgccccgccacccgccgctgaccgcgtgcggcctgccggccgcggggacggtggcctacggacaccccggcgccggcccgtccccgcactacccgcctcctcccgcccacccgtacccgggtatgctgttcgcgggccccagtcccctggaggcccagatcgccgcgctggtgggggccatcgccgccgaccgccaggcgggtgggcttccggcggccgccggagaccacgggatccgggggtcggcgaagcgccgccgacacgaggtggagcagccggagtacgactgcggccgtgacgagccggaccgggacttcccgtattacccgggcgaggcccgccccgagccgcgcccggtcgactcccggcgcgccgcgcgccaggcttccgggccccacgaaaccatcacggcgctggtgggggcggtgacgtccctgcagcaggaactggcgcacatgcgcgcgcgtacccacgccccctacgggccgtatccgccggtggggccctaccaccacccccacgcagacacggagacccccgcccaaccaccccgctaccccgccaaggccgtctatctgccgccgccgcacatcgcccccccggggcctcctctatccggggcggtccccccaccctcgtatcccccagttgcggttacccccggtcccgctcccccgctacatcagccctcccccgcacacgcccacccccctccgccgccgccgggacccacgcctccccccgccgcgagcttaccccaacccgaggcgcccggcgcggaggccggcgccttagttaacgccagcagcgcggcccacgtgaacgtggacacggcccgggccgccgatctgtttgtgtcacagatgatggggtcccgctaactcgcctccaggatccggacttggggggggtgtgtgttttcatatattttaaataaacaaacaaccggacaaaagtatacccacttcgtgtgcttgtgtttttgtttgagaggggggggtggagtgggggggaaagtgggccgaatgacacaaaaattaggtcggaggggtgaggggggggggctaggagccgaaccgatggcccccacacgcgacggaaggcccggaagactaccacggggagggggtgtggaaagcgaccggtcgcagggagacggggttggtttggggttggtttggggttggttttcccgttagcacatgtctgcatttgtttttctagtcacacgccccccccccccaaataaaaaccaaggcaaaacaataccagaagtcatgtgtatttttgaacatcggtgtctttttatttatacacaagcccagctcccctcccctcccttagagctcgtcttcgtctccggcctcgtcctcgttgtggagcggagagtacctggctttgttgcgcttgcgcagaaccatgttggtgaccttggagctgagcagggcgctcgtgcccttctttctggccttgtgttccgtgcgctccatggccgacaccaaagccatatatcggatcatttctcgggcctcggccaacttggcctcgtcaaacccgcccccctccgcgccttcctccccctccccgcccacgcccccggggtcggaagtcttgagttccttggtggtgagcggatacagggccttcatgggattgcgttgcagttgcaggacgtagcggaaggcgaagaaggccgcgaccaggccggccaggaccagcagccccacggcaagcgccccgaaggggttggacataaaggaggacacgcccgagacggccgacaccacgccccccactactcccatgactaccttgccgaccgcgcgccccaagtcccccatcccctcgaagaacgcgcacagccccgcgaacatggcggcgttggcgtcggcgcggatgaccgtgtcgatgtcggcaaagcgcaggtcgtgcagctggttgcggcgctggacctccgtgtagtccagcaggccgctgtccttgatctcgtggcgcgtgtagacctccaggggcacaaactcgtggtcctccagcatggtgatgttcaggtcgatgaaggtgctgacggtggtgacgtcggcgcgactcagctggtgagagtacgcgtactcctcgaagtacacgtagcccccgccgaagatgaagtagcgccggtggcccacggtgcacggctcgagcgcgtcgcgggtgaggcgcagctcgttgttctcgcccagctgcccctcgatcagcgggccctggtcttcgtaccgaaagctgaccagggggcggctgtagcacgtccccggccgcgagctgacgcgcatcgagttctgcacgatcacgttgtccggggcgacgggcacgcacgtggagacggccatgacgtctccgagcatgcgcgcgctcacccgccggccgacggtggcggaggcgatggcgttggggttgagcttgcgggcctcgttccagagagtcagctcgtggttctgcagctcgcaccacgcgacggcgatgcgccccagcatgtcgttcacgtggcgctgtatgtggttatacgtaaactgcagccgggcgaactcgatcgaggaggtggtcttgatgcgctccacggacgcgttggcgctgggcgcctcccgcagtggcgcgggcgtggcattccggggcttgcggtcctgctcccgcatgtactcccgcacgtacagctcggcgagcgtgttgctgaggaggggctggtacgcgatgaggaagccccccgtggccaggtagtactgcggctggcccaccttgatgtgcgtggcgttgtacttgcgcgcaaacatgcggtcgatggcctcgcgggcatcccggccgatgcagtcgcccaggtcgacgcgcgagagcgagtactcggtcaggttggtggtgaaggtggtcgagatggcgtcggaggagaagcggaaggagccgccgtactcggcgcggagcatctcgtccacctcctgccacttggtcatggtgcagaccgccggtcgcttcggcacccagtcccaggccacggtaaacttgggggtcgtcagcaagttgcgggtcgtcggcgacgtggcccgggccttcgtggtgaggtcgcgcgcgtagaagccgtcgacctgcttgaagcggtcggcggcgtagctggtgtgctcggtgtgcgacccctcccggtagccgtaaaacggggacatgtacacaaagtcgcccgtcgccagcacaaactcatcgtacgggtacaccgaccgcgcgtccacctcctcgacgatgcagttgaccgtcgtgccgtaccgatggaacgcctccacccgcgaggggttgtacttgaggtcggtggtgtgccacccccggctcgtgcgcgtggcgaccttcgccggcttgagctccatgtcggtctcgtggtcgtcccggtgaaacgcggtggtctccatgttgttccgcacgtacttggccgtggagcggcagacccccttggcgttaatcttgtcgatcacctcctcgaagggaacgggggcgcggtcctcgaatatccccataaactgggagtagcggtggccgaaccacacctgcgacacggtcacgtctttgtagtacatggtggccttgaatttgtacggggcgatgttctccttgaagaccaccgcgatgccctccgtgtagttctgcccctccgggcgcgtcgggcagcggcgcggctgctcaaactgcaccaccgtggcgcccgtcgggggcgggcacacgtaaaactgggcatcggcgttctcgaccttgatttcccgcaggtgcgcgcgcagcgtggcgtggccggcggcgacggtcgcgttggcgtcggggggcggggtcgcctcgggccgcttgggcggctttttggttttccgcttccgggccttggtggtcgcggggctcgggacggggggcggccgggaggcgggacccccgttcgccgcgacggtcgcggccacgccgcccgaggcgcggggggccgccggggccgccggggccgccgacgccaccgcggccaccagcgcccccacgaccagcgcgcaaatcaagccccccccgcgcatggcgggcctacgggggcgcgtcgctcccgccgcccgctagtctgggggcgaggtgctgcaggaccgagtagaggatggaaaaaacgtctcggtcgtaaaccacgaccgagcggggtccgatgcagccgtcggggccgctctcgacgatggccaccagcggacagtcggagttgtacgtgaggtacacgcccggcgggtagcggtacagaccttcggaggtcgggcggctgcagtcggggcggcgcaactcaagctccccgcaccggtagaccgacgcaaagagtgtggtggcgataatgagctcgcgaatatatcgccaggcggcgcgctgggtgggcgtgattccggaaacaccgtcaaaacagtagaacttttgaaactcgctgacggcccaatcagcgcccgaaccccccgcgcccatgatgaagcgggcgagttcctccttgaggtgcggcaggagccccacgttctcgacgctgtagtacagcgcggtgttggggggctgggcgaagctgtgggtggagtggtcgaacaggggcccgttgacgagctcgaagaagcgatgggtgatgctggggagcagggccgggtccacctggtggcgcagcagcgacgctcgcatgaaccggtgcgcgtcaaacacgcccggggcggcgcggttgtcgatgaccgtgcccgcgcccgccgtcagggcgcagaagcgcgcgcgcgccgcgaagccgttggcgaccgcggcgaaggtcgcgggcagcacctcgccgtggacgctgacccgcagcatcttctcgagctccccgcgctgctcgcgcacgcagcgcccgaggctggccagcgaccgcttggtcaggcggtccgcgtacagccgccggcgctcccgcacgtccgcggcggcccgcgtcgcgatgtcgccccagctctccggcccctgcgcccctggctcggggccgcgctccccgtcctcgctcgcgggcgtccccgcgccacgcctccgccccccctcctccgcggcggcccggggctcttcctcctcggcccccccggtcgcgccgccggcccccagccgcgccagcacgcggcgcagcgcctcctcgtcgcactgctcggggctgacgagccgccgcagcagcggcgtcgtcaggtggtggtcgtagcacgcgcgtatcagcgcctcgatctgatcgtcgggcgacgtcgcctggccgccgatgatcagggcgtccaccatgtccagcgccgccaggtggcccccgaacgcgcgatcgaagtgctccgcccgccgcccgaacagcgccagctccacggccaccgcggcggtctcctgctgcagctcgcgctgcgccagcgcgttcaggttgtcggcgaaggcgtccatggtggagtggcgggcgcgatcgccggacgccagccagaagcgcagctcgctgatggcgtacaggccgggcgtagtggcctgaaacacgtcatgcgcctccagcagggcgtcggcctcctcgcggacagaagagctatcggcgggcggcgggccggcccgggccccgccgcccgccgcggtccgcgccagcgcctggtccagcacacagagcgctcgcgcgcgggcggcgtccgacagcccggcggcgtggggcaggtaccgtcgcagctcgttggcgtccagccgcacctgggcctgttgggtgacgtggttacagatgcggtccgccaggcggcgggcgatggtcgccccctggttcgcggtgacgcacagctcctcgaaacagaccgcgcacgggtgggacgggtcgctcagctccgggggcacgatgaggcccgaccccaccgccgccaccataaactcccggacgcgctccagcgcggccgtggcgccgctcgggggggtgatgaggtggcagtagttcagctgcttgagaaaattctcgacatcatgcaggaagcacagctccatgcggacgtccccgccgtacgtctgcagccggatctgctggtggtacggacagggtcgggccagacccatggtctcggtgaaaaaggcagagacgtcacccgtggtcgcgaacgtttccaggtggcccaggagccgctccccctcgcgccacgcgtactccaggagcaactccagggtgaccgacagcggggtgagaaaggcggcggcctgagcctccagccccggccgcaggtgccgccgcagcacgcgcacctggagcgcgttgagctttagctgggcgagcttccccaggccgatctgggggtcgcatcgtcgaagcagctctagctgaaaaacgtacgtctgtacctgcccgagcagggccaacagtttctgtcgggccgcagtgggctcggaaaccgcggccgggggcgcggccgccatggcgagtcacccggccgtgctgtggtttagttaaggtttgggggggggtgggtcagaggcgcgccccgcgcggactgatgcggcggcgggcccctgacatcccctctttatgcccgtcgcccgcccgcccgccccgccggtgtgccgtgattcgcggagtcggggccttgtgtttctttctttcccccccgaatccgttctttcttcctcacccccccctccccacacacccacccaggactcgccaccacaaggaggcgagagcccgtcgctaacccaaagacacagtcacgagacacgatatcgactgtagttgcgatcgtttattttatacacaacaccaacctttccttcgaccccccccacccccgcccctagagcatatccaacgtcaggtcctttttctccggtggtccctccccaaacggatcgtcgccgtgaaacgcccgctttcgggcgacgccggccgcccccgccgccgccgccaaaccgccgaacgacgccgcgtggtcatcctcgtcgccgaaatccccaaagttaaacacctccccggcggcgccgagctggctgaccagggcctccgcctcgtgggccacctccagggccgcgtcggtcgaccactcgccgtgcccgcgctccagggcgcgggtggtaaactccatcatttcctcgctcaggtactcgtcctccagcagcgccagccagtcctcgatctgcagctgctgggtgcgggggcccaggctcttgacggtcgccacaaacacgctgctggcgaccgccgccccgccctccgcaatgatgccccggagctgctcgcacagcgaatgctcgtgggccccgcccccgagactcgacgccgcgcacacaaacccggccctggggcaggccaggacaaacttgcgggtgcggtcaaagatcagcagcgggcacgcgtttttgccgcccagcaggctggcccagttcccggcctgaaacacgcggtcgttgccggccatgccgtagtatttgctgatgctgaggcccagcacgaccatcgggcgcgcggccatcacgggccgcagcaggttgcagctcgcgaacatggacgtccaggcgccggggtgcgcgtcgagggagtccatcagcgcgcgggccccggcctccaggcccgcgccgccctgcggggcccaggcggccgccgcctgcacgctggggggacggcgggacccggcgatgacggccgtgagggtgtttatgaagtacgtcgagtggtcgcagtacctcaagatctggttggccatgtagtacatggccagttcgctcacgttattgggggccaggttgataaagttaatcgcgccgtagtccagggagaacctcttaatgaacgcgatggtctctatgtcctcgcgcgacaagagccgggcggggagctggttgcgctggagggcggtccagaaccactgcgggttcggctggttcgaccccgggggcttgccgttgggaaagatgaccgcgtggaactgcttcagcaggaagcccagcggtccgaggaggatgtccacgcgcttgtcgggcttctggtaggcgctctggaggctggcgacccgcgccttggcggcctcggacgcgttggcgctcgcgcccgcgaacaacacgcggctcttgacgcgcagttccttgggaaacccaagggtcacgcgggcaacgtcgccctcgaagctgctctcggcgggggccgtctggccggccgttaggctgggggcgcagatagccgccccctccgagagcgcgaccgtcagcgtcttcgccgacaggaacccgttgttgaacaggtccatgacgcgccgccgcagcaccggttggaattgattgcgaaagttgcgcccctcgaccgactgcccggcgaacaccccgtggcactggctcagggccaggtcctggtacacggcgaggttggaccgccgcgcgaggagctgcagcagggggcacggcccgcaggtgtacgggtccagcgacagcgacatggcgtggttggcctcggccagaccgtcgcggaacttaaagttgcgcccctcgatcaggttgcgcatcagctgttccacctcgcgatccaccagctgcttgatgttgttcaccaccgtgtgcagggcctcgcggttgccgataatcgtctccagcctccccagggccgtgggcaccgcctggtccacgtactgcagggcctcgagctcggccatgacgcgctcggtggccgcgcggtacgtctcctgcatgatggtccgggtgttctcggacccgtccgcgcgcttcagggccgagaaggcggcgtagttccccagcacgtcgcagtcgctgtacgcgctgttcatcgttccgaagaccccaatggccccccgggcggcgctcgcgaacttggggtggcgggcccgcagccgcatcagcgtcgtgtgcgcgcaggcgtggcgggtctcgaaggtacacaggttgcagggcacgtcggtctggcccgagtccgcgacgtagcgaaacacgtccatctcctggcgcccgacgatgactccgccgtcgcagcgctccaggtaaaacagcatcttggccagcagggccggagagaacccgcacagcatggccaggtgctcgccggcgaactcctgggttccgccgacgaggggcgccgtggggcgcccctcgtacccgggcaccacgtggccctcgcggtccagctgcgggttggccgccacgtgcgtgccgggcacgagaaagaagcggtaaaaggagggcttgctgtggtccttggggtccgccggcccggcgtcgtccacctcggtcaggtggagggccgaattggtgctgaacaccatggcgcccacgaggcccgcggcgcgcgccaggtacgccccgacggcgccggcgcgggccgcgggcgtttcctggccctcaagcaggggccacgtggtgatgtcggggggcggctcgtcaaagaccgccatcgacacgatggactccagggccagggcggcgtcgcccgccatcaccgaggccaggcgctgctcaaacccgcccgccgggcccttgttcccggcgtcgcgcgcgccccgctggggcttaccctggctggcctcgaaggccgtgaacgtaatgtcggcggggagggccgcgccctcgtggttttcgtcgaacgccaggtgggcggccgcgcgggccacggcgtccacgttccgggcacgcagggccacggcggcgggcccgacgaccgcctcgaacagcaggcgggcgagggggcggttgaaaaacggaagggggtagttgaaattctccccgatcgatcggtggttgcagttaaacggatcggcgatgacccggctaaaatccggcataaacatctgcagcggatacacggggatgcggtgaacctccgcgtccccgatggttaccttgtccatcccgcccagatgcaggaaggtgttgctgatgcacacggcctcccggaagccctccgtgatcaccagatacagcaaggcccggtccgggtccagtccgagccgctcgcacagcgcgtcccccgtcgtctcgtgctttaggtcgcagggccggggcgcgtagtccgcgaagccaaaatggcggcgcgcccgctcgcagagccgcgtcaggttgggggcctgggtgctgggggccaggtggcggccgccgtgaaagacgtaaacggacgggctgtagtgcgagggcataagcttgagggacaccgcggtccccccaaggcccgtcgtgcgggacccgacgaccgcggccacgttggcctcaaacccgctctccacggtcaggccgacgatgaggggcgcgacggcgacgtccgcgtcgccgctgcgcgccgacagtagcgacagcagctccaggccttcggccggacaggcgcggccatacacgtaccccatcggccccggaggaaccttgacggtggtcgtcgttttgggcttggtgtccatggctttcgggagatcggcgaccggcaggaacgggggcccggcaagacgaccgggggcagacgggggaggccgcgcgtggtcgacggctgctgcccgccgtcgtctctccgatggggtcgaatgccggcgctgggggtggggtctacacccgcccgttcgccgagcggcccctggtgggggtgggatgggtgggatggggtgggcgagaatggcccgccaccggatcgcgccggacgggggggcccggggttgggcaaggtttgggcgcaaggctccagcggcgattcgagaggcctgcggatggcggcccagagctgggtatgctcggccggggcggccggtatatgtacggcgtgctgggaggggcggcgtcgggccccgcccacggtccgccacgccccgcgcgtcatcggcagggggcgtggccgcccttctaaaaaaagtgagaacgcgaagcgttcgcactttgtcctaataatatatatactattaggacaaagtgcgaacgcttcgcgttctcactttttttagaagggcggccacgccccctttgacgtcacgctcacccgggcggccggccgcccataagcgcggcctgccgggccgataaaaagaaaccgcggcgcccccgcggacaccacacactggctctcgaaccccggacgcgcagaagggacccgggcgcgggtccgccggtaagagccggggggaacatcggcaccgccatcccaccccgagctgttgggtgggcgggtgggggggctggtgaggcggtggtgggagggggcggcgtatagcaggacaacgaccggcggcgatgttttgtgccgcgggcggcccggcttcccccggggggaagccggcggctcgggcggcgtctgggttttttgccccccacaacccccggggagccacccagacggcaccgccgccttgccgccggcagaacttctacaacccccacctcgctcagaccggaacgcagccaaaggccctcgggccggctcagcgccatacgtactacagcgagtgcgacgaatttcgatttatcgccccgcgttcgctggacgaggacgcccccgcggagcagcgcaccggggtccacgacggccgcctccggcgcgcccctaaggtgtactgcgggggggacgagcgcgacgtcctccgcgtgggcccggagggcttctggccgcgtcgcttgcgcctgtggggcggtgcggaccatgcccccgaggggttcgaccccaccgtcaccgtcttccacgtgtacgacatcctggagcacgtggaacacgcgtacagcatgcgcgccgcccagctccacgagcgatttatggacgccatcacgcccgccgggaccgtcatcacgcttctgggtctgacccccgaaggccatcgcgtcgccgttcacgtctacggcacgcggcagtacttttacatgaacaaggcggaggtggatcggcacctgcagtgccgtgccccgcgcgatctctgcgagcgcctggcggcggccctgcgcgagtcgccgggggcgtcgttccgcggcatctccgcggaccacttcgaggcggaggtggtggagcgcgccgacgtgtactattacgaaacgcgcccgaccctgtactaccgcgtcttcgtgcgaagcgggcgcgcgctggcctacctgtgcgacaacttttgccccgcgatcaggaagtacgaggggggcgtcgacgccaccacccggtttatcctggacaacccggggtttgtcaccttcggctggtaccgcctcaagcccggccgcgggaacgcgccggcccaaccgcgccccccgacggcgttcggaacctcgagcgacgtcgagtttaactgcacggcggacaacctggccgtcgagggggccatgtgtgacctgccggcctacaagctcatgtgcttcgatatcgaatgcaaggccgggggggaggacgagctggcctttccggtcgcggaacgcccggaagacctcgtcatccagatctcctgtctgctctacgacctgtccaccaccgccctcgagcacatcctcctgttttcgctcggatcctgcgacctccccgagtcccacctcagcgatctcgcctccaggggcctgccggcccccgtcgtcctggagtttgacagcgaattcgagatgctgctggccttcatgaccttcgtcaagcagtacggccccgagttcgtgaccgggtacaacatcatcaacttcgactggcccttcgtcctgaccaagctgacggagatctacaaggtcccgctcgacgggtacgggcgcatgaacggccggggtgtgttccgcgtgtgggacatcggccagagccactttcagaagcgcagcaagatcaaggtgaacgggatggtgaacatcgacatgtacggcatcatcaccgacaaggtcaaactctccagctacaagctgaacgccgtcgccgaggccgtcttgaaggacaagaagaaggatctgagctaccgcgacatccccgcctactacgcctccgggcccgcgcagcgcggggtgatcggcgagtattgtgtgcaggactcgctgctggtcgggcagctgttcttcaagtttctgccgcacctggagctttccgccgtcgcgcgcctggcgggcatcaacatcacccgcaccatctacgacggccagcagatccgcgtcttcacgtgcctcctgcgccttgcgggccagaagggcttcatcctgccggacacccaggggcggtttcggggcctcgacaaggaggcgcccaagcgcccggccgtgcctcggggggaaggggagcggccgggggacgggaacggggacgaggataaggacgacgacgaggacggggacgaggacggggacgagcgcgaggaggtcgcgcgcgagaccgggggccggcacgttgggtaccagggggcccgggtcctcgaccccacctccgggtttcacgtcgaccccgtggtggtgtttgactttgccagcctgtaccccagcatcatccaggcccacaacctgtgcttcagtacgctctccctgcggcccgaggccgtcgcgcacctggaggcggaccgggactacctggagatcgaggtggggggccgacggctgttcttcgtgaaggcccacgtacgcgagagcctgctgagcatcctgctgcgcgactggctggccatgcgaaagcagatccgctcgcggatcccccagagcacccccgaggaggccgtcctcctcgacaagcaacaggccgccatcaaggtggtgtgcaactcggtgtacgggttcaccggggtgcagcacggtcttctgccctgcctgcacgtggccgccaccgtgacgaccatcggccgcgagatgctcctcgcgacgcgcgcgtacgtgcacgcgcgctgggcggagttcgatcagctgctggccgactttccggaggcggccggcatgcgcgcccccggtccgtactccatgcgcatcatctacggggacacggactccattttcgttttgtgccgcggcctcacggccgcgggcctggtggccatgggcgacaagatggcgagccacatctcgcgcgcgctgttcctccccccgatcaagctcgagtgcgaaaaaacgttcaccaagctgctgctcatcgccaagaaaaagtacatcggcgtcatctgcgggggcaagatgctcatcaagggcgtggatctggtgcgcaaaaacaactgcgcgtttatcaaccgcacctccagggccctggtcgacctgctgttttacgacgataccgtatccggagcggccgccgcgttagccgagcgccccgcagaggagtggctggcgcgacccctgcccgagggactgcaggcgttcggggccgtcctcgtagacgcccatcggcgcatcaccgacccggagagggacatccaggactttgtcctcaccgccgaactgagcagacacccgcgcgcgtacaccaacaagcgcctggcccacctgacggtgtattacaagctcatggcccgccgcgcgcaggtcccgtccatcaaggaccggatcccgtacgtgatcgtggcccagacccgcgaggtagaggagacggtcgcgcggctggccgccctccgcgagctagacgccgccgccccaggggacgagcccgcccccccagcggccctgccctccccggccaagcgcccccgggagacgccgtcgcatgccgaccccccgggaggcgcgtccaagccccgcaagctgctggtgtccgagctggcggaggatcccgggtacgccatcgcccggggcgttccgctcaacacggactattacttctcgcacctgctgggggcggcctgcgtgacgttcaaggccctgtttggaaataacgccaagatcaccgagagtctgttaaagaggtttattcccgagacgtggcaccccccggacgacgtggccgcgcggctcagggccgcggggttcgggccggcgggggccggcgctacggcggaggaaactcgtcgaatgttgcatagagcctttgatactctagcatgagccccccgtcgaagctgatgtcccgcatcttgcaataaatgtctgcggccgacacggtcggaatttccgcgtccgctggtttctctgcgttgcgtctgaccacgagcacaaacgtgctctgccacacgtgggcggcgaaccggtagccggggcacgcggtcagcatccgatcgatgagccggtagtgcaggtgggccgacgtgccggggaagatgacgtacagcatgtggcccccgtacgtggggtccgggtaaaaaagaaaccgggggtcgcacgccccccctccgcgcaggatcgtgtgcacgaaaaagagctcgggctggccgagcgtatcggccaggaggtcctggaggggggtgctgtggcggtcggccagcacgaccagggaggccagaaaggtgcggtgctcaaagatcgtattgatctgctgcacgaaggccaggatgagggcctcgcggctgacggtggccagccgcccgtcgcccgcgctgcacgcggggcagcagcccccgatccccaggtagtagcccatgcccgagagggtcaggcagttgtcggccacggtctggtccaggctgaaggggagcgacacgggggtcgtcttcaccaggggcacggagagcgagcgcacgatggcgatctcctcggagggcgtctgggcgagggcggcgaagaagccgcggtagcgacggcgctcgtgcaggcagagctccagcctgcgcgcgtgcgacggcaggctcttgcgggaggcccggcgctccacgccggggttcccggcggcggaaaagcgcgaccgccgccgggtcttgtcgcggccgggcccgggccgggagccggagcgacggggggcgatgtcatacataggtacagagggtgtgctccagggacaggagagagatcgagtgtcgtctgagcagcgcgccggcctcgcggacaaatgtggccagcgcggtgggcttcggcacaaatacctggtacgtcttgaaggtgtagatgagggcccgcagggctatacagacccgcccctcgaactcgttgccgcaggccaacttggccttgtgaagctgcagctcgtcgcgatggtcggcgcgggggtggccaaacaggacccaggggtcgacttccatctccgtgatggcgcacatcggatcgcagaacatgtgcttgaagatggcctcggggcccgcggcccgaagcaggctcacgaaccggcccccgtccccgggctgcgcctcggggtccgcctcgagctggtccacgaccggcactatgcagtcgaagaggctggtgttgttctccgagtagcggacgacggacgccctcaggcgtcgcatggccagccagtaggcccgcaccagcaacagattgcacagcaggcattccccgccggtgcgcccgcggccccggccgtgcttcagcacggtggccatcagcgggcccaggtccaggtcgggctgggcctggggctcggcgaactgcgcaaaacgcggggccgcgtcgcgcatgcgcgccccgcggtgcgcttcccaggactcgctgaccgcggcgcggcgggcgtccgcggcggcgcgcagccggggccccgactcccagacggcgggggtgccggcgagcagcagcaggatcaggtcggcgtacgcccacgtctccggctcacccccctgcgccagcgccccggcggcggcctcgaactccccgttgcgggcggcggcgcgcgtgcagcagctgtctccgcccccgcgcttgccctcggtgcagtcgagcaggcgggcgcagtccttccagttcatcagggcggtggtgagggagggttgcgttcccgagcccccgcccgcccccgcccccgccccgtcatcgcccccggaggccagggtcccgatgagggcccgggttgcggactgcgcgaggaaggaatagttggagtactgcaccttggcggcgcccggggagggcgtcggcctgggttgcttctgggcgtggcgcccgggcaccccgccgtcggtccggaagcagcagtggagaaagaaatgccggtggatgtcgttgatggtcagggcgaagcgcgcgaaggagccgacaagggtcgccttcttggtgcgcaggaagtggtggtccatgacgtagacgaactcgaaggcggccacgaagatgctcgcggcgcagtggggcgcgcccaggcacttggcgcagaggaacgcgtaatcggccacccactggggcgagaggcggtaggcctgcttgtacagctcgatggtgcggcagaccagacaggggcggtccagcgcgaaggtgtcgacggacgccgcggcgaagggccccgtgtccaagagtccctctgccgtggggtctgcgggcgggccgcgggcggaccccggcccccgcccccccgaagcctcgcgcgcggccccgcgcggccgcgggggggcgggcgcgacgtcgctctccacgtcctcgtcgagcgcgctcgcgggcggcacgcctaccacgtgacaggccgccaggagctcggcgcacagggcctcgttaagagccagaaggtcgggatcgaaggccacatacggacgctcgaacgcgccctccttccagctgctgcccggcgactcttcgcgcacggcggcgctcgacggcacccccggggcggacgtcgccatggccggtcgagcggggcgcacgcgtccgcgaacgttacgggacgcgatccccgactgcgcgctgcggtcccagaccctggaaagtctagacgcgcgctacgtctcgcgagacggcgcgggggacgcggccgtctggttcgaggacatgacccccgccgaactagaggttatattcccgaccacggacgccaagctgaactacctctcgcggacgcagcggctggcctccctcctgacgtacgccgggcctataaaagcgcccgacggccccgccgccccacatacgcaggacaccgcgtgcgtgcacggcgagctgctcgcccgaaagcgcgaacggttcgcggcggtcattaaccggttcctggacctgcaccagatcctgcggggctgacgcgcgcttcggcggggcaccggcaccgggaccgacttgttttacataacagtagggggtgggggaacgcgcacccttgcccggtcgcgatggcggggatggggaagccctacggcggccgcccgggggacgcgttcgagggtctcgttcagcgcatcaggctcattgttcccgccacgctgcgcggcgggggtggggagtcgggcccctactcgccatccaacccgccctcgagatgtgccttccagttccacggccaggatgggtccgacgaggccttcccgatcgagtacgtcctgcggctcatgaacgactgggccgatgtgccctgcaacccctacctgcgcgtgcagaacaccggcgtttcggtgctgtttcaggggttttttaaccggccccacggcgccccggggggcgcgatcacggcggagcagaccaacgtgattctgcactccaccgagacgacgggactgtccctcggagacctggacgacgtcaaggggcgcctcggcctggacgcccggccgatgatggccagcatgtggatcagctgctttgtgcgcatgccccgggtgcagctcgcgtttcggttcatgggccccgaggacgccgttcgcacgcggcggatcctgtgtcgcgccgccgagcaggccctcgcccgtcgccgccggtccaggcggtcccaggatgactacggggcggtggtggtggcggcggcgcaccactcttccggagcgcccgggccgggggtcgccgcctcgggcccgccagcgccgcccggacggggaccggcccgtccgtggcatcaggccgtgcagttgttccgggccccgcgtccgggccccccggcgcttctgttgctggcggcggggctgtttctgggggccgctatctggtgggcggttggcgcgcgcctatgaaagggggcgagccaccgtcccgcccgccagtgcatcccagacgcccgcgagccgcacatcccctccgctcccgcctccggcccgattcttacggcgcgacccaaggtcccgatggccgccccgcagtttcaccgccccagcaccattaccgccgacaacgtccgggcgctcggcatgcgcgggctcgtgttggccaccaacaacgctcagttcatcatggataacagctacccgcatccgcacggaacgcagggtgcggtgcgagagtttcttcgcgggcaggccgcggcgctgacggacctcggggtgacccacgccaacaacacgttcgccccgcagcctatgttcgcgggcgacgccgcggccgaatggctgcggccctcgttcggtcttaagcgcacgtattccccctttgtcgttcgcgaccccaagacccccagcaccccgtgagtcctcggcgggtccctccgcggccgtctctcgttgcccccctttcccccttcccgggtggttcaataaaaaacaccaacatacgatattcgcgtttgatacgtttattggggggggtgtagggcccaacgatcggcgattaacaacaccaaacaatcgagcgcgtctaacccagtaacatgcgcacgtgatgtaggctggtcagcacggcgttgctgcgctgaaacagcgccctgcgggtccgctgcagctgttgttgtatgcggcggcatgcgcggatcaaaaccgccagggcgctacgaccggtgcttcgtacgtagcgtcgcgacaagacggcatttgcctgtacgggcaaggggccaaattgcgagtgtggtgactggaggtggtcggcggccaatgggccgggtggttcgtcggcggggggcaagtgcggttccggtgggagggggtcgagcgcctcggtatcatccgagtccgagaaacgcagggagtctgcgtcggagtgttcatcatcggaggagatgtgcagcgtctgaagcagcgatgcgggtgggggcgcggagtcgacgtgaagcgcgagagaggaagcccacgaagtcacagcggacactgggaggtgggtgtttgtatgtgtgggagactcgggcgtcgggaccgagtctcggctctggggtgtaagcgtccgagttacgggcggcaggggcggctggggcaggggcggctggggcaggggcggctggggcaggggcggctggggcaggggcggctggggcaggggcggctggggcaggggcggctggggcaggggcggctggggcaggggcggctggggcaggggcggctggggcaggggcggctggggcaccgagcgcgcgcggatgcgcgtccgcgcggcgggtttggtcgcgggtgactggggtggggggcggcgggcaaccgggcctccgggcacgacccaaccgcacaaaggctcgctcggggcaaccgggcctggggccaaaggcggggggctggtctggacggcggaggtcgggggggcaaggcccggagaaggcggcactgccgccgctgcggcggaaaccgcggccgcgtggtcggctgggtcccggggagaggggagggagttcaacgaggccgagagcgaggcgaccgcggggcgcgtgaggcgccggggtgggccggccgcggggccccgggggggtgtcggcgagggacccgctgttgtctggcggcggccgcggcggcggtcgcccccggggacgaccgctccttcggcgggcggaggcgggatgggcgcgagcgtgggggcgggaaaggccccgcgagccgaggcggggccgggcggaaggggcaaagcagaaacccaagccgggggcgcggactccggggtgggcggctggtcgggaggacgcgcggaagcggcgaccggggcgaccggggcggggagtgccggcggacgccacccctcggggggggcggaggcccggggcgcgcgcgatttggcacgcgtccggcgggacctgcgcacgcgcggcacggcggcggagaaagcggcggcagagccggaaaaggccgggggaggaagcgcggcatccgcggggggactcggtgtgggtggcgagggccgtgggtcgtcgcgaggggccacgggcacgcgccccgtgttttgttgaggcgggacactcggtcgtgtttcgcgagccgtagctgccggcccgatgggccgcggtgcgtactgggacgtggggacggactgatcggtggcgggggggggaagaagggccggggccggattgggcgtggggccgccggcgtcgtcggacgccagctcctccaggccgtggatccaggcccacatgcgaggggggacgggctcgccggtggtggcgtcggtgaggagagtgggggcgaggacccccgggtccgcctgccgtgcggggggggcagcggggtcctcgggacccgatccgccatccccccccgcaaggtcccgcgggtcgcgggcggcggtcggggcagagggacctgcctcgtcggcgagggggcgctggtaaaccgggtgtcccgggaacagctcccccgtcaggagggaggcgtcgaagggccgcccgaggatggcccgcgcgaagaaggggtccgcgtcggcggcgctcgccgcgagaacgtcccccgcggtagccacaaacggaagctcctcggtggcctcgctgcccacaaaccgcacgtcaggggggccggggggctccggggcttcccacaagaccgcgaccggggtcatggagatgtccacgaggaccaggcacgggggcccgtcggcgagagggcgctcggcgatgagcgccgacaggcgcgggagctgcgccgccagacacgcgttttcgatcgggttgagatcggtgtggaggaggccgacggcccacgtctcgatgtcggacgacacgacgtcgcgcagggcggcgtccggcccgccggggcgcgagtcgaagagcgtcaggcacagttccagttccgactcgcgggagaaggccgtggtgttgcggagcgccaccacgacgggcgcgccgaggagcaccgcggccagaaccaggtccatggccgtaacgcgcgcggcgggggtgcggtgggtcgcggcggccagcacggccacgtgctggcccgtgggtcggtagagggcgtggggggcctcggggagggacgccttgcgcccccccgccgggccgagcgtctggccagactccaggcgtgcggccaggagggcgtcgaagctgtcgtactcggtgtagtcgtcgggaaacatgcaggtccacagcgcggccaaagcggcgctcggcagacacatgcgcccgaggacgctcaccgccgccagggcctgggccggactgagcttcccgagcgccgggacgtcccggcgctgggtcccgagctccaaggccgagcgccagggcgccagcgggtcggtttcggacagcttgccccggcgccagtcggccagccgcgtgccgaacaggaggccccgggtcggggggcctccgtccaaaaacgtcggcaacacgcggatgcgggcgtcgggatgcggggtcaggcgctggacgaacagcatggactccgctgcgtcctcgaacgcgcgttcgagggtgaggtgcatgtactcgtgctggcgaacgaggtccaggcgccagaagttgtagatgtgttccggaacgccggccaccagcgcgaccagcacgtcgttctcgttgaaggcgacgcagtggcgctgggacccccgggggcccggcggcggacgcggcgccgccgctccggacgcccagcccagctgggcccagcgacacccaaactcgcgcgtgagggtggtggcgacgagggcgacgtacagctcggccgccgcgtccatcgaggcgccccacgtcgcctggcgatggcgcacgaagcgaccgaacagctgaaagttggcggcctgggcgtcgctgagggccagctggagccggttcacgacggtcagcacgtacatggccgtgaccgtcggggccgattcgaggacgtccgtcggaagcgggggccgcacgcaggccgcctcgggacgcatcagcagcgcgccgagtttgtcggtgacggccgggaagcatagcgcgtactgcagcggcgttccgtccggggccaaaaagctggtggcgaacggcagatccagagcgctgacggcctcacgcagcaccaggggccccgggtctccgccggcgcgcagatacgcctcgccccggcggcgcagcagctgcgggtcgacctcgtggccctcgggggaagaagaggcccgggcgcgggcgtcgagggcgcgaagatcaacgagcaggggcgcgggcgcggactccgcgcccgcgcccgtctggccgccggccctggcgtacgcgctatataagcccatgcggtattggatgagttcccgcgcgccccggaactcctccaccgcccacggggccaggtccgcggccgccgcgtcgaactccgccagcaggcgccccagggcgtcaaagttcatctcccagggcaccctgcgcaccacctcatcccgcagccgggcgcacagggcggtgtgcttggtgacgcgcgcgcccagctcctccacggcctccgcgcgctcggcgcccttggcgcccaggacgccctggtacctggcggaaaggcgctcgtaggccggctgggcccgcagccccgacaccgtgttggtggtgtcctgcagggcgcgcagctgctcgtgcatggcgcggaacccctcgggggacttccaggcgcccccccggacgcggccaaagcgaccccagacctcgtcccactccgcctcggcctcctccagggacctccgcagggcgtcgacgcggcgccgagtatcaaagagcgcccccaggcggccggcgtgccgcgccagggggccggggccgtcgccgcgggcggcgcttagcgggtgcgtctcgaaggtgcgctgggcgtgctctagccagataaccgcgggcacgtcgagctcgcgcgttttctcggtctgatccaacagaacctcgacctggtcggcgatctccgccaccgagcgcgcctggtcgagcgtcttggccacggtcgccgggacggcgaccaccttcagcatggtcttgaggttggccaggccctcggcctcgatctgggcccggcgctcgcgcgcggccagcgcctcccgcaggcccgccatgacccgctcggtggcctccgcgcgctgctgtttggcgcgcaccactgcgtccttggtctcggccgtgtcctgccgggtcacgaaggcgacatactcggcgtacgccgtgttcttcacggggctctggtccacgcgctccaacgccgccgcgcacgcgaccagcgcgtcctcgctgggacacggcagggtgaccccggtccggaccagctccgcggtggcctccgggtcattccgggccgcggatatctgctccgcggcggccgccaggtccaggggcacgccgccgagcgcccggtgcacgtcggcccggatggcgtccaggcgatcgcggagctccacgtagtcggcgtagccatgttggaagaacggcacgtaccggcgcaggccgggcacgctcgtcatgtcgtccgccaggcgccccacggcctcgtggtagtcgataaacccgtcgcccgcctgggccatttccaggagcccctccgcgatgcgcagcagccgcgccaggggctcggcgtcgacccgaaacatgtcggcgtaggtttcggcggcggcgtggaacgccgcgctccagccgaggcggtggatggcggcgagcggggggagcatggggtggcgctggttctcgggggtgtaggggttaaacgcgaaggccgtatccagggcgagggtgaccgcctcggcgttggccgcgagcgcctgctcggcgcgcttgcggaagtcccgggggttgtagccgtgcgtgcccgccagcgcctgcaggcggcgcagctcgaccacgtcgaactcggcgcggttctcgacgcggtccagcgccgcctcgacgccggcggcccagcgctcgctgctgccccgggcgcgctgggccgccatcttcgccgtcaggtcggcgacggcggcctcaagttcgtcggcgcggcgtcgcgtggcgccgatgaccttgcccagctcctgcagggcgcgcccgctgggggaatggtccccggccgtcccttcggcgtgcagcaggcccccgaacccagcctcgtgccccgcgaggctttcccgagcagcggtcgtcgcgcgggccgcggcatcgatgagggcggcatggtccccctccggctgggcgcaggcccggcgcgcctggactaccaggtcggcggccgccgaccccagggtcgtgagctcgtcgatggccccccgcgcctccagggccagccgagtcgcctttacataccccgcggcgctatcggccagcaccgcgaggaaggacaggggcgaggccgggtcgcgggcggccgcgcccagggccgacaccgcgtccgccagggcgccatgcgcccgcacggccgcgtccaccgtcgccgcgggacttgccgtcgcgacggcggcgctcccggcgttgatggcgtttgacacggctttggcgattgtgggggcgtgatcggaaaagaactgcacgaggaccggcgtctcgggggcgtcggcgaacagggtcttcagcaccaccacgaaggcgggatgcaggccggccagagccgtcgcggtatccggggtcgggtgttccagggcctcccggtactgccccagcagcccccacaggtccgcccgcagcgccgccgtgacttccgggggggggccccggacggcatcggccaggtcggtccaccccgcgggcagggaggcccgcagggtcgccagcacggccggacacgcctttagccccacaaagtccgggaggggccgcaggaccccttggagtttgtgcaggaacttctcccgggcgtcgtgggccaccttggcgcgctcccgcgcgtcgttgagcatcgcctccagggcgtgggcgcgctcccgaagccgggagcgcgcctccggagcgagctccgccgtcatcttggccgcctccatggccctcgcctgccgcagcgcgtcttcggccatgcgcgtggcctcgggggacagcccgcccccgtcgacgtacggcgcggggccggtcgccgggacgaaggccgcgtcgctgtccagctgctgcgcgagcgccgcgtcgagggcgtcgaagcgctgcagttcggccagccccgagctgcgccgcgcctgctggtcgttgatgccgtggatgctgcgcgccagctcttccaggggcttgcgttcgatgagcccctgggtcgcggcgtcggtcaggaccgagagccaggccgccaggtcctcgggggcatctagggtctggccccgctggagcaggtcccgcagcaggatggcctgggggctggtggcgagggggggcgggggggggagcgcggcgcgctgagcgacgtcccgcgtgtgttggtcaaaggccggtagcgattccagcaactggaccatgggcacgaccgcggccgaggccacgtgaaaccgacagtcgtggctgtcgctggcctgcagggccttcgcgctgtatacggctccccggtggaagtactccttgaccgcgctctcgatcgcccggcgggcctggatccgcacgtcctccagccgcgcctggatggcctcggggcccagggcgggcgggcacggggccctgccgccggcgcccggggcggcgggcacgggcatcacggtcaggggcccggcgcgctgcgagaccgagtcgaccccgcgggcgagggcgtctaaggcctcgcgcatctcgcgggcctccgcctcgacccgcatctcttcgccccgggcaaactgggccagcgcctggatccgatggagaagcggctccgggtgcgtcggggtggcgggggcgaacagggtgttcgggtgggcgcgcgagcgctccaggagccactctccgaggcgtgcgtacagattggccggcggggcggcgcgcagctgcagatccaggtccgcgaggtccccgtaaaaggcgtccgtctcccgaataacgtccctggcgaccaggaccagcttagcgagggccaggcgcccgatctgcgaattttcgtccagcacgtgctggatgaggggccggtgggcggccacgtccgccaggctcatgcgcgtggacgccaggaagtccccgacggccgttttgcggggcagcatgcgcagggtgaagtccagcagggccgcggccgggccggccaccccggcctgcgtatgcgtgcgggccccgttctcgatcaaaaaggcgaggacgcgctcaaagaagaagatgacgcagagctccaacagccccgggtgcgccgggtacggcgaccgcagggcgttgatggtgagctgcgaacacgcggccacctcgcgggccagggcggcatcgcgcgccgcgagccggaccgccgtggcggccacattggggtggacctcgaacagctgcgccaggtcggcgccggggggctccggggggcggcgggcccccagcgtctcgagcacggacggcgacgacgggctcgcgggcccgtcgtcgccgccgccctgcccggactgcgggggggtatccggtgcgggagggaccgtggcggctatgggcgtcggggaggaggcggggacctcggcggcgacgggggccttcttcttgggcgcggacttcttcttggccttggcgggcggggccttgggggcgggcctctcgcccgaggtcagatcctccacgctggacggtggggtccaggtgggccggcggcgcttgggcaagccggtagaatagcgcgcccggtggcgacccaccggcactgcccccacctccaggacccgcaggtcctcggcttcttcggccgcgtccccggcgggtgtctgcgggggcggggcggcgtgcggtggacccgaggccgcggcgtccggggccgagggcttcgcgggcggggtcccctccagggctgctgcccacacatcatcgggggggcggtttgggtgccccgcctgcggtgtgtcgggtgggcccgaggccccccggggggcctcggggggccggtcggccccaggggtctggacgtgggtgggcgcggggagcgcggggacgaccgggcccgagccttctccgtcccccctggggaccacaccgacaaagagcgccccgagccccccgatctcgccccgcagggggtgggtgatggccacgcgccgctcgacgaacggttcgtcctgcaggtaagtctcgctggccccgtagaggtgcagggccgcggcggtcaggtccgccggcgccacggcccccgggccggagggcacaaaaaacaccatggcgcccgcccaccgcaccttggggcggtcgtgggcgtaatacgtcaggtacgggtacacgtcgcccgcccgcaccttggcgataaacgcgggcgttcccgcgggcaggccgtgcgggtcaaacagataggccgtgtcgccgtcccggtagagccccatgcccagggggccgatggtcaggagcgtgtaggacagcggccgcatggcccaggggccggcgaagaacgtgtgcgcggggcattgcgtctccagcagccccgccgtgggctccccgaagaagcccacctcgccgtacacccgcgaaaacacgcaacgcaggccgccgcgcgccgccgggtactccaggaagttggggagctcgataatggaacacatgcgcggcggcccggagcccgcggccgcgcgcgtccactcgcccccctccaccagacatccctcgatggcctccgcggacagcacgtcgcggggccccacgtcgaaaagaagactgagaaacgacagggacgagcgcatgcacgataccgacccccccggctccagatcggtcgcgaactggttccgaacaccggtgaccacgatatcgcgatccccctggcgcttcatcgtggggtgaggtagcgcggccggaatcatgtgtgccgcgcccgccacgagcggggcctgtttatgggccgggcgtcccgatgagtactgttgtttccgccgcccgaacccccccgcccatcaaccgcctgttcgtccccctaaccacacacccggtatcgcgtgtgtgtggtttcccgggaagacacatcccaccccatgaagttttgccctttttttccgtcccgcactacgccacctttccaccccccccccaaaaaaacaacaaccaactcccagatggatgggtgcgataataaagctttattattgtttaaccaaaggcgagtcctacgggtgtaccggtggtgtctcctgcggcgtcatctcgtcgtcctccacgggggtgttgggccaagggaccgtctcgcggcccgccgggcgcgtcgacggcgcgcgggcctgcgtgtcctgtgggccgggtgtcgtgggttcgggggtgctaccgccggcatcttgggcctccaggtccccgggggcccccgggccggcggaaggccgaaacgccgaggcgcgaaacacgccgtcggtgacctgcaggagctcgtttattaatagccagtccatgctcagcgtagcggccagcccctggggagacaggtccacggagtccggaaccaccgtcggctgacccaggggccccaggctgtagtccccccaggcccccaggtcatgacggttcgtgagcacgacgaggtctgcggccgggctggggggcgcgtcctcggtcgcgtgggccatcacctcctgaatggctgcggtgcgctgatcggccgagctggcgaagggcgccacgaccagcgcgcgctccgtctgcaggcccttccacgtgtcgtggagttcctgaacgaactcggccacccgctcggggcccgtggccgcgcgtgcggcctgatagccggccgagaggcgccgccagcgcgccaggaactgactcatgtaacagaacccggggacctggtcccccgacatcaactttgacgccctggcgtggatgcccgacacgatggccaggaacccgtggatttcccgccgcacgacggccagcacgttaccctcgtgcgagacctgggccgccagctcgtcgcataccccgaggtgcgccgtcgtctcggtgacgacggaccgcagccccgcgagggacgcgaccagcgcgcgcttggcgtcgtgatacatgccgcagtactggctcaccgcgtcgcccatggcctcggggcgccagggccccaggcgctcgtgggcgtctgcgaccacggcgtacaggcggtgcccgtcgctctcgaaccggcactcaaagaaggcggcgagcgtgcgcatgtgcagccgcagcagcacgatcgcgtcctccagctggcggaccagggggtcggcgcgctcggcgagctcctgcagcaccccccgggccgccagggcgtacatgctgatcagcagcaggctgctgcccacctcgggaggctgggggggaggcagctggaccgcgggccgcagctgctcgacggcccccctggcgatcacgtacagctcgcgcagcagctgctcgatgttgtcggccatctgcatcgtgggcccgacgccggcccgggtggccggttcgaggagggtgatcagcgcgcccaattttgtgcggtgcccctcgacggtggggagatagcccaggccgaagtcgcgcgcccaggccagcacccgcagggcaaactcgatggggcggggcaggtaggcagcgttgcacgtggccctcagcgcgtccccgaccaccagggccagcacgtaagggacgaaccccgggtcggcgaggacgttggggtggatgccctccagggccgggaagcggatcttggtggccgcggccaggtgaaccgagggggcgtggctaggcggcccgacggggagcagcgcggacagcggcgtggccggggtggtgggggtcaggtcccagtgggtctggccgtacacgtcgagccagatgagcgccgtctcgcgcaggaggctgggctggccggcgctgaagcggcgctcggccgtctcaaactcccccacgagcgtgcgccgcaggctcgccaggtgttccgtcggcacggccgggcccatgatgcgcgccagcgtctggctgaggacgccgcccgacaggccgaccgcctcacagagccgcccgtgcgtgtgctcgctggcgccctggatccgccggaacgttttcacgtagccggcgtagtgcccgtactcccgcgcgagcccgaacacgttcgcccccgcaagggcaatgcacccaaagagctgctggatctcgctgagcccgtggccggggggcgtccgcgcgggcacccccgccaccaaaaacccctccagggccgatatgtactgggtgcagtgcgcgggcgtgaaccccgcgtcggtaagcgtgttgatcaccacggagggcgagttgctgttctggaccaaagcccacgtctgctgcagcagcgcgaggagccgttgctgggccccggcggagggcggctcccctagctgcagcaggccggtgacggccggacggaagatggccagcgccgacgcactcagaaacggcacgtcggggtcgaagacggccgcgtccgtccgcacgcgcgccatcagcgtccccgggggcgcgcacgccgaccgcgggctgacgcggcttagggcggtcgacacgcgcacctcctcgcgactgcgaaccattttggtggcctcgaggggcgggatcatgatagccgggtcgatctcccgcaccgtgtgctgaaactgggccagcagcggcggcgggaccaccgcgccccgatcgggggtcgtcaggtactcgtccaccagcgccagcgtaaacagggcccgcgtgaggggggtcagggcggcgtcgtcgatgcgctgtaggtgcgccgagaacagcgtcacccaattgctgaccagggccaagaaccggagaccctcttgcacgatcggggacgggaagagcaggctgtacgccggggtggtcaggttggcgccgggttgccccaggggaaccggggacatcttaagcgacatctccccgagggcctccagggaggtccgcgggttcatggccaggcagctctgggtgacggtccgccagcggtcgatccactccacggcacactggcggacgcgcaccggccccagggccgccgtggtgcgcagcccggcggcctccagcgcgtgggtcgtgtcggagccggtgatcgccaggaccgtgtccttgatgacgtccatctcccggaaggccgcctcgggggtctcggggagcgccaccgccatgcggtgcaccagcagcccggggaggttctcggccaagagcgccgtctccggaagcccgtgggcccggtgcaaggcgcacagttgctccaggagcgggtgccagcacgcccgcgcctccgccgggccgaccgccgcgcccgacaacagaaacgccgccgtggcggcgcgcagtttggccgcggacagaaacgccggctcgtccgcgctgcccgccggctcgctcgagggggagggcggccggcggaggttggtcaggctccccaacaggacctgcaacggtccgtttgggggtggagcggacgggggggtcatgccggcgggcgccgggacctggagcgcgctgtccgacatggcgaccggcgtgcgcgctcggcgacgcggcgcggagaccgcgggcccaaacgggaatgactgccgccgccctatacggaggggctaagtatcgcccggggacccttcgaaaccccgggcgtgtcgcaagtacgccgcgaaggcgcggcgtgttatacggcgcgttatgtcccggcattccgttcgtgggttcgggcccgggtgctgtcgggtgggagtgtgtgtgggggggggcggcgcgacggcggcccggaccaagtgtatcgcggccgttccgtggggcggcccaacaggccctttaaacatttgcgtatgcaccggcccagccagtcggacaccggaacccaccagaggcggaagccgccttcgcccgtgagggtgcgtgtgttttctggtggcgtgtttttcctttccgccctcctccctccccacctccaccacccccccccacaactcgcccgttggcgatcggcgggaaaaccatgaaaaccaagccactcccgacagccccgatggcgtgggccgagagtgccgtggaaaccaccaccagcccgcgcgagctcgcgggccacgccccgctccggcgcgtcctgcgcccgcccatcgctcgccgcgacggcccggtgcttttgggggacagggcccccaggaggacggccagtacgatgtggctgctggggatcgaccccgcggagtcgtctccgggaacgcgcgctacccgagacgataccgagcaggccgtggacaagatcctcaggggagcccggcgcgcgggagggctgaccgtccccggcgccccccgctatcacctgacccgccaggtaaccctgacggatctctgccaaccaaacgcggagcgggccggggcgctccttttggccctgcggcaccccaccgacctcccccacctggcccgccatcgggctccgcccggccggcagaccgagcgactggccgaggcctggggccagctcctggaggcctccgccctggggtccgggcgggccgagagcggctgcgcgcgcgcgggccttgtgtcgtttaactttctggtggccgcgtgcgccgccgcctacgatgcgcgcgacgccgccgaggcggtccgggcccacatcacgaccaactacggcgggacgcgggccggggcgcggctggaccggttttccgaatgcctgcgcgccatggtccacacgcacgtgtttccccacgaggtcatgcggtttttcggggggctagtgtcgtgggtcacacaggacgagctggctagcgtcaccgccgtctgcagcggaccccaggaggccacacacaccggccacccgggcaggccccgttcggccgttaccatcccggcctgcgccttcgtggacctggacgccgagctgtgcctggggggccctggggcggcgttcctgtacttggtcttcacctaccgacagtgccgggaccaagagctctgttgcgtgtacgtggtcaagagccagctccccccgcgcggactggaggcggccctcgagcggctgttcgggcgcctccggataaccaacacgattcacggggccgaggacatgacgccccctcccccgaaccgaaacgttgactttccgctcgccgtcctggccgcgagctcgcaatccccgcggtgctcggcgagccaagtcacgaacccccagtttgtcgacaggctgtaccgctggcagccggatctgcgggggcgccctaccgcacgcacctgcacatacgccgccttcgcagagctgggtgtcatgccagacgacagcccccgctgtctgcaccgcaccgagcggtttggggcggtcggcgttccggttgtcatcctggagggcgtggtgtggcgccccggcgggtggcgggcctgcgcgtgatcgtctattgacgacggccgcccaacccgagcgaccttcccctcccacttccccccccctacacaccaactccgccctcgccgtcttggccgtgcgcggccccgtgcgtccgtctcaataaagccaggttaaatccgtgacgtggtgtgtttggcgtgtgtctctgaaatggcggaaaccgacatgcaaatgggattcatggacacgttacacccccctgactcaggagataggcatatcctccttagattgactcagcacacgatcgcaccccacccctgtgtgccggggataaaagccaacgcgggcggtctgggttaccacaacaggtgggtgcttcggggacttgacggtcgccactctcctgcgagccctcacgtcttcgcccaccgattcctgttgcgttcctgtcggccggtgctgtcctgtcgacagattgttggcgactgcccgggtgattcgtcggccggtgcgtcctttcggtcgtaccgcccaccccgcctcccacgggcccgccgctgtttccgttcatcgcgtccgagccaccgtcaccttggttccaatggccaaccgccctgccgcatccgccctcgccggagcgcggtctccgtccgaacgacaggaaccccgggagcccgaggtcgccccccctggcggcgaccacgtgttttgcaggaaagtcagcggcgtgatggtgctttccagcgatccccccggccccgcggcctaccgcattagcgacagcagctttgttcaatgcggctccaactgcagtatgataatcgacggagacgtggcgcgcggtcatttgcgtgacctcgagggcgctacgtccaccggcgccttcgtcgcgatctcaaacgtcgcagccggcggggatggccgaaccgccgtcgtggcgctcggcggaacctcgggcccgtccgcgactacatccgtggggacccagacgtccggggagttcctccacgggaacccaaggacccccgaaccccaaggaccccaggctgtccccccgccccctcctcccccctttccatggggccacgagtgctgcgcccgtcgcgatgccaggggcggcgccgagaaggacgtcggggccgcggagtcatggtcagacggcccgtcgtccgactccgaaacggaggactcggactcctcggacgaggatacgggttcggagacgctgtctcgatcctcttcgatctgggccgcaggggcgactgacgacgatgacagcgactccgactcgcggtcggacgactccgtgcagcccgacgttgtcgttcgtcgcagatggagcgacggccccgcccccgtggcctttcccaagccccggcgccccggcgactcccccggaaaccccggcctgggcgccggcaccgggccgggctccgcgacggacccgcgcgcgtcggccgactccgattccgcggcccacgccgccgcaccccaggcggacgtggcgccggttctggacagccagcccactgtgggaacggaccccggctacccagtccccctagaactcacgcccgagaacgcggaggcggtggcgcggtttctgggggacgccgtcgaccgcgagcccgcgctcatgctggagtacttctgtcggtgcgcccgcgaggagagcaagcgcgtgcccccacgaaccttcggcagcgccccccgcctcacggaggacgactttgggctcctgaactacgcgctcgctgagatgcgacgcctgtgcctggaccttcccccggtcccccccaacgcatacacgccctatcatctgagggagtatgcgacgcggctggttaacgggttcaaacccctggtgcggcggtccgcccgcctgtatcgcatcctgggggttctggtccacctgcgcatccgtacccgggaggcctcctttgaggaatggatgcgctccaaggaggtggacctggacttcgggctgacggaaaggcttcgcgaacacgaggcccagctaatgatcctggcccaggccctgaacccctacgactgtctgatccacagcaccccgaacacgctcgtcgagcgggggctgcagtcggcgctgaagtacgaagagttttacctcaagcgcttcggcgggcactacatggagtccgtcttccagatgtacacccgcatcgccgggtttctggcgtgccgggcgacccgcggcatgcgccacatcgccctggggcgacaggggtcgtggtgggaaatgttcaagttctttttccaccgcctctacgaccaccagatcgtgccgtccacccccgccatgctgaacctcggaacccgcaactactacacgtccagctgctacctggtaaacccccaggccaccactaaccaggccaccctccgggccatcaccggcaacgtgagcgccatcctcgcccgcaacgggggcatcgggctgtgcatgcaggcgttcaacgacgccagccccggcaccgccagcatcatgccggccctgaaggtcctcgactccctggtggcggcgcacaacaaacagagcacgcgccccaccggggcgtgcgtgtacctggaaccctggcacagcgacgttcgggccgtgctcagaatgaagggcgtcctcgccggcgaggaggcccagcgctgcgacaacatcttcagcgccctctggatgccggacctgttcttcaagcgcctgatccgccacctcgacggcgagaaaaacgtcacctggtccctgttcgaccgggacaccagcatgtcgctcgccgactttcacggcgaggagttcgagaagctgtacgagcacctcgaggccatggggttcggcgaaacgatccccatccaggacctggcgtacgccatcgtgcgcagcgcggccaccaccggaagccccttcatcatgtttaaggacgcggtaaaccgccactacatctacgacacgcaaggggcggccatcgccggctccaacctctgcaccgagatcgtccacccggcctccaagcgatccagtggggtctgcaacctgggaagcgtgaatctggcccgatgcgtctccaggcagacgtttgactttgggcggctccgcgacgccgtgcaggcgtgcgtgctgatggtgaacatcatgatcgacagcacgctacaacccacgccccagtgcacccgcggcaacgacaacctgcggtccatgggcattggcatgcagggcctgcacacggcgtgcctgaagatgggcctggatctggagtcggccgagttccgggacctgaacacacacatcgccgaggtgatgctgctcgcggccatgaagaccagtaacgcgctgtgcgttcgcggggcgcgtcccttcagccactttaagcgcagcatgtaccgggccggccgctttcactgggagcgcttttcgaacgccagcccgcggtacgagggcgagtgggagatgctacgccagagcatgatgaaacacggcctgcgcaacagccagttcatcgcgctcatgcccaccgccgcctcggcccagatctcggacgtcagcgagggctttgcccccctgttcaccaacctgttcagcaaggtgaccagggacggcgagacgctgcgccccaacacgctcttgctgaaggaactcgagcgcacgttcggcgggaagcggctcctggacgcgatggacgggctcgaggccaagcagtggtctgtggcccaggccctgccttgcctggaccccgcccaccccctccggcggttcaagacggccttcgactacgaccaggaactgctgatcgacctgtgtgcagaccgcgccccctatgttgatcacagccaatccatgactctgtatgtcacagagaaggcggacgggacgctccccgcctccaccctggtccgccttctcgtccacgcatataagcgcggcctgaagacggggatgtactactgcaaggttcgcaaggcgaccaacagcggggtgttcgccggcgacgacaacatcgtctgcacaagctgcgcgctgtaagcaacagcgctccgatcggggtcaggcgtcgctctcggtcccgcatatcgccatggatcccgccgtctcccccgcgagcaccgaccccctagatacccacgcgtcgggggccggggcggccccgattccggtgtgccccacccccgagcggtacttctacacctcccagtgccccgacatcaaccaccttcgctccctcagcatcctgaaccgctggctggagaccgagctcgtgttcgtgggggacgaggaggacgtctccaagctctccgagggcgagctcggcttctaccgctttctgtttgccttcctgtcggccgcggacgacctggtgacggaaaacctgggcggcctctccggcctcttcgaacagaaggacattcttcactactacgtggagcaggaatgcatcgaggtcgtccactcgcgcgtctacaacatcatccagctggtgctctttcacaacaacgaccaggcgcgccgcgcctatgtggcccgcaccatcaaccacccggccattcgcgtcaaggtggactggctggaggcgcgggtgcgggaatgcgactcgatcccggagaagttcatcctcatgatcctcatcgagggcgtcttttttgccgcctcgttcgccgccatcgcgtacctgcgcaccaacaacctcctgcgggtcacctgccagtcgaacgacctcatcagccgcgacgaggccgtgcatacgacagcctcgtgctacatctacaacaactacctcgggggccacgccaagcccgaggcggcgcgcgtgtaccggctgtttcgggaggcggtggatatcgagatcgggttcatccgatcccaggccccgacggacagctctatcctgagtccgggggccctggcggccatcgagaactacgtgcgattcagcgcggatcgcctgctgggcctgatccatatgcagcccctgtattccgcccccgcccccgacgccagctttcccctcagcctcatgtccaccgacaaacacaccaacttcttcgagtgccgcagcacctcgtacgccggggccgtcgtcaacgatctgtgagggtctgggcgcccttgtagcgatgtctaaccgaaataaaggggtcgaaacggactgttgggtctccggtgtgattattacgcaggggaggggggtggcggctggggaaagggaaggaacgcccgaaaccagagaaaaggaccaaaagggaaacgcgtccaaccgataaatcaagcgccgaccagaaccccgagatgcataataacgattttattactcttattattaacaggtcgggcatcgggaggggatgggggcgcgcgtttcctccgttccggctactcgtcccagaatttagccaggacgtccttgtaaaacgcgggcgggggcgcgtgggcccacagctgcgccagaaaccggtcggcgatgtccggggcggtgatatgccgagtcacgatggagcgcgctaaatcttcgtcgcggaggtcctgatagatgggcagtctttttagaagagtccagggtccccgctccttggggctgataagcgatatgacgtacttgacgtatctgtgctccaccagctcggcgatggtcatcggatcgggcagccagtccagggcctccggggcgtcgtggatgacgtggcggcgacgtccggcgacatagccgcggtgttccgcgacccgctgcgcgttggggacctgcacgagctcgggcggggtgagtatctccgaggaggacgaccgggcgccgtcgcgcggcccaccggcgacgtccgggggctggaggggggggtcttcttcgtagtcgtcctcgcccgcgatctgttgggccagaatttcggtccacgagatgcgcgtctcgaggccgaccggggccgcggtcagcgtaggcatgctctccagggagcgcgagttggcgcgctcccgccgggccgcccggcgggcctgggatcggctcggggcggtccagtgacactcgcgcagcacgtcctcgacggacgcgtaggtgttattggggtgcaggtctgtgtggcagcggacgaacagcgccaggaactgcgggtaactcatcttgaagtactgcagcaggtcgcggcagtgaatcgtcggaatgtagccggtgctgatgtccaacacgatatcgcagcccatcagcaggagatcggtatccgtggtatgcacgtacgcgaccgtgttggtatgatagaggttcgcgcaggcgtcgtcggcctccagctgacccgagttgatgtaggcgtaccccagcgcccgcagaacgcggatacagaacaggtgagccaggcgcagggccggcttcgagggcgcgcccgagggggccgccgggcctgggccggcggcccgcgttccccggtcccccggggcgaaggcgtgcccgcggcggcgcatgttggaaaaggcgaaactgggcctggagtcggtgatgggggaaggcggcggcgaggcgtctacgtcactggcctcctcgtccgtgcggcactgggccgtcgtgcgggccaggatcgccttggccccgaacacaaccggctcggtacactcgaccccgcgatcggtcacgaagatggggaacagggacttttgggtaaacacccgtaacatactacagagacagtgtagcgtgattgcctcgcggtcgtaacttgggtagcggcgctgatatttaaccaccagggtatacatgacattccacaggtccacggcgatgggggtaaagtagccctccggggcccggaggccccggcgcttcaccagatggtgagtctgggcaaacttcatcatgccaaacagacccattccggcacgattgtaggtgcggataggtctctctacagagctgtataggtgtgacggtccgggacacccaagcccgccgcccctgtgtacagtggctgcggcgacgaccccgctccaacaagacgctatcccgggaaaggcacgctctttataattcttttttatttcccatctacgtgcggattggtgcaaccgccggcgcgcgccggtgcaggccgaccatctctctcttccccccctccccctcccccgagccctcaaagagggtgtggcctaactagcggaaggcgtatttaaccagactagggcggcgggtccgccgtagtccttggctcgggtagccactgctctgtggctcgggtcccccggcccccctaacccccatccggtccgcgtcatccgccccctccgcctgcgacacaaacggccgcgcctccgggcccggtgacacgacgcgcctcgtctctgcggattgtcccgggagcgtcgcggcatggctcatcttcccggcggtgcggccgccgcccccctttcggaggacgcgatcccgtcgccgcgcgagcggacggaagactggccgccctgccagatagtgctgcagggcgccgagctgaacgggatcctgcaggcctttgcgccgcttcgcacgagccttttggactcgctcctggtcgtgggcgaccgaggcatccttgtacataacgcgattttcggcgagcaggtgtttctgcccctcgaccattcgcagttcagtcgctatcgatggggcggacccaccgcggcgttcctgtctctcgtggaccagaagcgatccctgctgagcgtgtttcgcgccaaccagtaccctgacctgcggcgggtggagctgacggtcacgggccaggccccgtttcgcacgctggtgcagcgcatatggacgaccgcgtccgacggagaggccgtggagcttgccagcgagacgctcatgaaacgcgagttgacgagcttcgcggtactactcccccagggcgaccccgacgtccagctgcgcctcacgaagccccagctcacgaaggtggtgaacgccgtcggggacgagaccgccaaacccaccacgttcgagctcggccccaacggcaagttttccgtgtttaacgcgcgcacctgcgtcacctttgccgcccgcgaggagggcgcgtcgtccagcaccagcgcccaggtccagattctgaccagcgcgctgaagaaggcgggccaagcggccgccaacgccaagacggtctacggggaaaacacacaccgcacattctcggtggtcgtcgacgactgcagcatgcgggcggtcctccggcggctccaggtcggcggggggaccctcaagttcttcctcacggccgacgtccccagcgtgtgtgtcaccgccaccggccccaacgcggtgtcggcggtgtttcttttaaaaccccagcgggtctgcctgaactggctcggccggagcccgggttcctcgaccgggagcttggcgtcccaggactctcgggccggcccgaccgacagccaggactcctcctccgagccggacgcgggcgaccgcggcgccccagaagaagaaggcctcgagggccaggcccgggtaccgcccgcgttcccggaaccgccgggaaccaagcggaggcaccccggggccgaagttgtccccgcggacgacgccaccaagcgcccgaagacgggcgtgcccgccgcccccacgcgagccgagtcgccccccctctccgcgagatacggacccgaggcggcggagggtggtggggacggcggccgctacgcgtgctactttcgcgacctccagaccggcgacgcgagccccagccccctctccgccttccggggtccccaaagacccccatacggctttgggttgccctgacggcaacgggtggtggccgaacgcctcaccgcgcccgggcacgcggggtgcgttgtgttaaaaaaataaataaatggggtagtgtgtcccccccccctccaaccaatatggctgtcgtgtgtggttccgggttgcgcctccgtcctttccaccccccttccccctccttttttgttttgcgtgcgcttataagagcgggcccggggcccttcgcagcttcaccgagagcgccgtcgggccccgggtgcgggatgtgtcgcggggacagccccggggtcgcgggcgggagcggcgaacactgcctcggaggggatgatggggacgacgggcgcccccgcctcgcctgcgtgggtgccatcgctcgggggttcgcgcatctctggctccaggccgccacgctgggcttcgtggggtctgtcgttctgtcgcgcggcccgtatgcggacgccatgtcgggggcgttcgtgatcgggagcaccggcctggggttcctccgcgccccccccgcgttcgcccggccgccgacgcgtgtgtgcgcgtggctgaggctggtcggcgggggagcggccgtggccctgtggagcctcggggaggccggcgcgcctccgggggttccgggcccggcgacccagtgcctggcgctcggggccgcctacgcggcgctgctggtgctggccgacgacgtccatccccttttcctcctcgccccgcggcccctgtttgtcggcaccctgggggttgtcgtcggcgggctgacgataggcggcagtgcgcgctactggtggatcgacccccgcgccgccgcggccctgacggcggcggtggtggcgggcctcgggacaaccgccgccggggacagcttttccaaggcctgtccccgccaccgccgcttttgcgtcgtctccgcggtcgagtctcccccgccccgatacgccccggaggacgccgagcggccaacagaccacggacccctgttaccgtcgacgcaccaccagcgatctccgcgggtctgcggcgacggggccgcacggcccgaaaacatctgggttcccgtggtgacctttgcgggcgcgctcgcgctggccgcctgcgccgcgcgagggtctgacgcggctccgtcaggcccggtcctgccgctgtggccccaggtgtttgtcgggggccacgcggcggcgggcctgacggagctgtgtcagaccctcgcgccccgggacctcacggacccgctgctgtttgcgtacgtcggattccaggtcgtgaaccacgggctgatgtttgtggtccccgacatcgccgtatacgcgatgctggggggcgccgtgtggatctcgctgacgcaggtgcttgggctccggcgccgccttcacaaggacccagacgccgggccctgggcggccgcgaccctgcggggcctctttttctccgtctacgcattggggtttgcggcgggggtgctggtgcggccgcggatggcggcgagccggcggtcggggtgatcgccatttcaaataaaaggcacgagttccccgaataccaccggcgtgtgatgatttcgccctaccgctccgatccccggggggaggggggaaggaaatgggggcgggggtgccgtggacgggtataaaggccaggggggcaggcgggcccatcactgttagggtgttaggttgggaggtggcacaaaaagcgacactcccgtgttgtagttgtccgcgggaggcggtggtttccggcaaccctcctcgctgcgccgggcgcgcccaccggtccttcgcgggggccggggctcttctggtcatggcccttggacgggtgggcctagccgtgggcctgtggggcctgctgtgggtgggtgtggtcgtggtgctggccaatgcctcccccggacgcacgataacggtgggcccgcgggggaacgcgagcaatgccgccccctccgcgtccccgcggaacgcatccgccccccgaaccacacccacgcccccccaaccccgcaaggcgacgaaaagtaaggcctccaccgccaaaccggccccgccccccaagaccgggcccccgaagacatcctcggagcccgtgcgatgcaaccgccacgacccgctggcccggtacggctcgcgggtgcaaatccgatgccggtttcccaactccacccgcacggagttccgcctccagatctggcgttatgccacggcgacggacgccgagatcggaacggcgcctagcttagaggaggtgatggtaaacgtgtcggccccgcccgggggccaactggtgtatgacagcgcccccaaccgaacggacccgcacgtgatctgggcggagggcgccggcccgggcgccagcccgcggctgtactcggtcgtcgggccgctgggtcggcagcggctcatcatcgaagagctgaccctggagacccagggcatgtactactgggtgtggggccggacggaccgcccgtccgcgtacgggacctgggtgcgcgttcgcgtgttccgccctccgtcgctgaccatccacccccacgcggtgctggagggccagccgtttaaggcgacgtgcacggccgccacctactacccgggcaaccgcgcggagttcgtctggttcgaggacggtcgccgggtgttcgatccggcccagatacacacgcagacgcaggagaaccccgacggcttttccaccgtctccaccgtgacctccgcggccgtcggcggccagggccccccgcgcaccttcacctgccagctgacgtggcaccgcgactccgtgtcgttctctcggcgcaacgccagcggcacggcatcggtgctgccgcggccaaccatcaccatggagtttacgggcgaccatgcggtctgcacggccggctgtgtgcccgagggggtgacgtttgcctggttcctgggggacgactcctcgccggcggagaaggtggccgtcgcgtcccagacatcgtgcgggcgccccggcaccgccacgatccgctccaccctgccggtctcgtacgagcagaccgagtacatctgccggctggcgggatacccggacggaattccggtcctagagcaccacggcagccaccagcccccgccgcgggaccccaccgagcggcaggtgatccgggcggtggagggggcggggatcggagtggctgtccttgtcgcggtggttctggccgggaccgcggtagtgtacctcacccacgcctcctcggtgcgctatcgtcggctgcggtaactccggggccgggcccggccgccggttgtcttcttttccaccccttccgtcccccgtacccaccacaccccaccccacccccccgccgtcccccgggcgttataagccgccgcactcgcttttcccaccggaaaatcctcggcccgatccgaacggcgcacgccgcgtgggctccaaacgcctccggaagagagcgccccgccccgatattcaagcccgcggtggtgctatggctttccgtgcttcgggacccgcctaccagcccctcgcccccgcggcctccccggcgcgggctcgtgttccggccgtggcctggatcggcgtcggagcgatcgtcggggcctttgcgctcgtcgccgcgttggttctcgtaccccctcggtcctcgtggggactctcgccgtgcgacagcggctggcaggaattcaacgcgggatgcgtcgcgtgggaccccacccccgtcgagcacgagcaggcggtcggcggctgcagcgcgccggccacccttatcccccgtgcggccgccaagcacctggccgctctgacacgcgtccaggcggagagatcgtcgggttactggtgggtgaacggagacggcatccggacctgtctgagactcgtcgacagcgtcagtggcatcgacgagttttgcgaggagctcgcgatccgcatatgctactacccacgaagccccggcgggtttgtccgcttcgtaacttcgatacgtaacgccctggggttgccgtgaggcgcgcgtccgacggtcccgcttctcgcctctcttcttcccccaccccacccaccgaccaacgacggcgtttggccaataccctccttttttctttttctcttccccccccccccaaaaaaaacaataaacagctaattgcgtacgacaaaccatgcggaactcgctgttttttttctctgtttgttactttttattgaaacagacatacggggaaaggggccggaaaccgagacggtggggccggcggtcgcatttttttaatggctctggtgtcggccgcgtttgagcttcgtcaacagggcgctgagggcggcgacgttcgtcgggccgtcgttggccagcgcgttggtccgggggcgggcgggcatgggcgacaggcttagtcccgggtccggggcgcgtgtggcccccggaggggagaagagggcagacccgccccagtcgtacaggggattttccgcctcgatgtacggggagtccggggcgtctcccggcagggcggccccgccggcaagacgccggcgagggcagatgttttcgtatacccgaacccaggggatctcctcgtagacgcgccccccatcctcgcccaccgactcgtaaatggaatctgcgtcctcggagggggcgcggggggcgtggctttcggccggccaggcggcggcggcggtggtgtcggcggcgggggtggcgccaagcccgacgcccgcgggcatggcggcgtcatcgtcgggcagcagatacgtgttttccatctggtccggttcggcctccgcgtccggcccccaggtccgcaccgcgtcgtagaccccggcggcctcgcgctgagccgcgagcgggcgcgccgcggctgccggccgctgctcggggggcgcggggttgcggggcgggaggcgcgggggcgccccggccatatgcgtgtaatacgtggccggccggccggcgcagggctcgggaccccggtcggccgcgtcgacgtgcgggggctcggggaggtcctcgcggtggcgcctgaacctccgaggggccgcgggggtcgagtgggggcgagcccgggggagcggcgggggtgcgttgtcgcgccgggtccgttgtatcttgtcccggcagctcccgccgaccgcgccgcggccccccggtgggccggacgccgcgaggcgcaggatggactcgtagtggggcgacggggttccgctccgaagcaggtccggggccagggcggccccgaaccaggacttgatgctgagttccatccgggcccagctcggggcggtcatcgtggggaacaggggggcggcggtcctgcagaagcgctcctggctgtccaccgccgcccgtaggtactcgttgttcaggctgtcggaggcccagacgacatacccggtaagcgtcgcgttaattatatactgggcgtggtggtggactatggatagaacctcgacggtcgagacgatggcgtccacgatcccgtacgtgccgccgctgcgcttgccggtctcccacaggtgggccaggcgcgtcaggtggcccaggacgtcgctgaccgccgcccgcagggccatgcactgcatcgagcccgtggtgccgctgggcccgcggtccaggtggcgcgcaaacgtctccgcgggcgcctccagactcccgctgagcgccacgaaccggcgatcggcggggcccaggcggcgacacacgtacttgtccgccgtccacagcatccacgaggcccaatggtacaacacggagacgtaggccaggagctcgctcagccgcagtgcggtgtccgtgctcggccggctcgggtctgcggggcgcataaagaacatgtactgctggagcctgtgggccgcgtcgcgcaaccccgccaccgcggcggcgtacttggccgcggcggccccgctcttgaacggggcgcgcaccagcagcttcgggagcagggtgggccgcagcagcacgtgcaggctggggtcgcagtcgcccgccgggtcgtcggggatgtccaggccgctgggcacgaccgtctggaggtacttccagtactgcgctaggatggcgcggctcagctggccgcccgacagctccacctcgccgagcgcctgcttggcggccgacgcgtagtgccggatgtagtcgtagtgcgggtcgctggcgagcccgtctacgatcaggctctcggggacggtgttatggtgccgcgccgccagccggacgctgcgatcggcgccggtcagaaacgccggctgcaggtcgtcggcgcgctgccgcaggacgcccacggccgcgctgaggagcccctccggggtggggagcagacacccggcgaagatgcgccgctcggggacgcccgcgttggcgccgcggatgaggttggccggcgtcaggcaccgcgccagccgcagggagctcgcgccgcgcgcccggcgttgcatggcggagaccgttcggtcgggggccccgccggtcggaggtatgccgcgtcccgggatatagggttgctttttatggggaggcgcctatgggcgtggcgggccgcccagcccggtcgcgcgcctcccggacacgtgcgcccggagggcggcggtctcctcgtcgcccatgagcagtttccgaaactgcgccatgatgtccacgacgcggacccgcggccccagcacggactcgctattcaggggggcgggggggaaggccgccaggtcttcgagcaggaaggcggggtctgccgtcccgctcacgggcgcccggggcgccgaggacgcggggcgaaggtccacgtgttccgcggcggcgcgcacgtccgcccaaaatttggcgggggtggtccgcgcgtacaggggctgggtcgcgcggaggacgcacgcgtagcgcaggggggtgtacgtgcccacctcgggggccgtcgacccgccgtcaaacgcggccagggccacgcacgcgaccaccgtgtcggccaggcccagcagccgctgcaggatgagccccgtcgccagcacggcgcgcgcggccgccgcgtcgtccctgcgccggcgcgcgtccccgcaggccagggcgtatttcagggtaacggtcgccagggccgtgtgcagcgcgtacacggccgcgcccagcacggcgttcagcccgctggtggcgagcaggcggcgcgccgcggtgtcgcccagcgcctcgtgctcggccgccacgaccccggggctgcccaggggcagggcgcgaaacagcgcctcctgctccacgtccgcaaacgcggggtgggcggagtgcgggtgcaggcgcgcccccacgaccaccgagagccactggaccgtctgctccgccaggaccgccagcacgtccaggacgcgccccgcaaacgcggcctcccgcgggagcacgcatttgacggcgccggggttgaagcgggcgagcagagccccggtggcgatgtacgtcatgcgccccgcgtagcgggcggccacgcgacagtcgcgccccaggagcgcgcgcaccccgggccagtacagcagggaccccagcgaactgcgaaagaccgcggcgtcggggccggggtgggggggcgcggcccctcccgcgctgagcagcggcacggcggcggcccccacgggccgcaacgccgtgaggctcgcgaactgccgtcggagctcggccgccctgtcgtcgagctccgagccgcgcccctccgtgtgcaggcgcgtcccgcagacccacccgttgatcgccacccgcacgatggcgtccaccagaaagcccatcgcgcgggaggggctggtttttgcccgccgatccgtcaggtcgaggatcgcgtcgcccgtgacgtaccaggccagcgcctcgccctgctgcagcgtctggcggaaaaacacctttgggtcggccggggaggcaaagtgcatgacccccacgcgcgacagcccgaacgcgctatccggacacgggtagaacccggccggatgtcccagggccagggccgagcgcacggactcgtcccacgcggcgactcggggggtcaggcggtccagggggaatgccgcctgcagctccgggcccgacacgcggcccgcgagaatctcgaccgtcgcggaaggccgcgccccggcgccgtcatcgtgcgcgacggcggcggggtagtcgtcctcctcgtagttgagctcgtccaggaacagcggcgagggcaccacccgcgaaccgcccacccgccccaaaacgtcgcgtgggtccatcgggcccaggtagcctccccgcggggcccgcgtgatggcgctgtcccggcgtccgcgaacggactggctcctggccgtaacggacctggggcgcggaaaggacgcccggcgggggggcgccgccgcccgggcctcggacgcgcgtcgggacccggggtgaccgcgggcctcccggcgacggcgcgggggcggctcttcgctcgccatctcccccgcggcctcgacctcgctgtcgtcgtccacgttaaacaccgcccgcaggtaccccattaacccgactccaccgccctcgggctcgtcctccacgggcgagtcggcgcgatgcgcggacggggcatgggaccgggtggaggcgcgcctccggcgtacggcatgcccgcgcacggacatggtggccggaggcccgattttttacacacgccctccccgcagacggacgaggaaaggggtggtgcgaggggggaggcccaaacggggaggtggggggtagggggcggtcccagggagcggggggtaggaaccggcacgacgggaacagagaaaacgcgaccgctccaacaagggtgggggggtgggcctcgtccccacgcagacccgcgggcaaatgcgagaacgggacccgcgcgcctgcctttatacgcggaccccagcaccacgagccgttctgtgacgcgaatctacacgaccgcgggctcgtaggcgcgactaacgcccaacccaacggcacacaccccccaccccgcgcgtaaccccatttctttcatggtcccgtaataaacagccaacgcacgccgcgtatgatgagttgcttgccaatgtttattgctgtggttgcgaaccctctatcgcgatacagacggaggtgaggcggggcggtggtgggggggggcgcgccgcccggtcgcacatcctaccccccaaagtcgtcaatgcccatggcatcggtaaacatctgttcaaactcaaaatcgtccacgtccaaagccccatacgagacggggtcgtgggtcattcccggggagggggactccacgtcccccagcatctccaagtcgaagtcgtccagggcgtcggcgggcgtcatatccacctcctcgccgtccaggcggagttcgtctcccaggctgacgtcggtaatgggggcggtggtggacagtctgcgggggcgttgtcccgcggagagaaacgacatgcgcggcgccaccagcccggcctccgcgggagcgtcatcgtcgtccgggaggtcgagcaggccctcgattgtcgatccgtaattgtttctggtccgcccgcggctatacgcgtgctcccgcatgacggactcgccctccgaggtcgcgacgctggagtacgagtccaacttggcccggatcagcagcataaagtacccagaggagcgggcctggttgccctgcaggacgggcggggtcgtgaggggcgccccgggttcctccgccgccgcacttcgcaccagcgggaggttcaggtgctcgcgaatgtggtttagctcccgcagtcgccgggcctccacgggaactccccgcacggtgagcgatccgttgataaacatcaggggctgaaacagacacgccaactggcgccagctctccaggtcgcagcagaggccgtcgaacagatcgggccgcatcatctgctcggcgtacgcggcccataggatctcgcggctcagaaagaggtatagatgcagaaacaggacgcgcgccaggcgcgcggtctcgcggtagtacctgtccgcgatcgtggtgcgcagcatctcccgcaggtcgcggttgcggccccgcatgtgtgcctggcggtgtagctgccgaacgctggcgcgcaggtaccggtacagggccgagcaaaaatttgccaacacggtccggtagctctcctcccgcgcccgcagctcaccgcggaaaaactgcgccatggcctcgtagtacgaaggcagctcgtcgcgggtggcgggcagggtggggaacgccacgtcgccgtgggcgcgaatgtcgatcggggagcgctcggggacgtgcgcatccccccagtcgatcacgtcgctgggcagcgtcgacagaaacttgcactcccggtacatgtcggcgttggtcgggaacccagagaacaggtcctcgttccaggtatctagcatggtacacagcgcgggacccgcgctgaagcccagatcgtcgaggagacggttaaacagggccgcgggggggacgggcatgggcggcgagggcatcagctgggcctgactcagccgaccggtggcgtacagcggaggggcggctggggtgttcttgggacccccggctggcctggggggcggtggcgaaaccccgtccgcgtccgcaaacagatcgtcgaccaacaggtccatgggggcggttgggtccgggaataacgatctcgagaggcgaatgagacgtgcccgagcgcccggcggcggagagggggggagggatccgggacccgcgacagaaaaaggccggggccctcgcgaagggaatcgccgggggtgccgtgcgtccccgaggactgacatctcgcgtccaccaccccgcatttaagtatcaccccagtgccgccccaaacctcgtgacttccccaccgctccgggcggcccgtcccccgcgctcggaagggaggcgtgtccttcctcccgcccctcccgcccctcccgcccctcccgcccctcccgcccctcccgcccctcccgcccctcccgcccctcccgcccctcccgcccctcccgcccctcccgcccctcccgcccctcgccacaaacgcgtgctgacagcgaagtggttaaatcgaccgtgatgctttattgtctgtcgtctgaacgcggtcggggtcgctactcgagggggcggcggggacgggaagccgagcgggcgggggcccgtgcggtcgcggcggcacgccccgcggggcggccccgggcggccgcggtcgcgtcgacgtcctgcgccgcgtcgggattcaccaactcgttcgcgcgctgcaggaggttcttgccctcgcagaccgtcacgcgaatggtggtgaggtcgaggagctcgttgaggtcttcgtcggtgtgcggccgcgacatgtcccacagctgtaccgccgccagccgggcgtgcgtggccgccaggcgcccgaccgcggcgcagaagacgcgcttgttgaacccggccacccggggggtccacggcgccgtggggctcggtggggcggtgctgaagtgcagcttcttggccagtccctgggcgggtgtcttggttcttcccgaggccgtgggagcgggggcgtctaggagcacggcggagtcggcctgggcgggtcgcctgccgcgggcggggtcggtcgccggggtcgcggaggccttaggcgccccgcgcgtcattttgggggtccgcgcgggaggggcgtgcgagcgcccgccggcgcccacggggcccccggggggtggaggagcgcgcgcggggccggggccgtgagagcccgcgacggacgccgaacgacgcggtcgcgcggtatcccgggactcgtcgtcgtccgaagacgagtcccggtagagggcatacccagcctcgtcataatggagaaagcgaacctcgcccctcgggcgcgcgcgcatcgggccagcgccgcggcggaagtcgtcgcgcggactctctgggtccgccggggagaccgggccatagtacagctcctcgtgggtcccgcgcggcgcttcccgcggacacgacttgacggagcggcgagaggtcatggtctatcggagacaccggggacgcccgtgcggatcacagggaaggcgtcggcgaaggaggcagagagcgtcggaaggcggcgagggagggaaagagggagaccggcggggtacgggagagcagcgagggcctgcgtaacccacgggggccgcgggagtggctccctgcgggttgcgggggagagtttataggaagtggatataaccgcaggcgacgggactaaccaatccccgggggggcaacggacagacacgccccgaacaggcccgacttccgcgaggaagcaaaggccgggggccgcccaacgacacgcccaccccttcccaacagggcgggctcaggctgacccggcggccagtgcccgctgacatatctgatacacgtgcgcgatcatacatacgcccatcgaggtcatgcctagataaaagggcaccaggacccccgggacggacaccacaccggcgctgtcgccccggcattgcgcgtccccgataacgccgcgtgcgcctgccgcgttcggcggctccccgggcacgcccgcgacgagcgcgacgaacaacagcaccacccagcggcccagtcttgcgggtttccccgtcatcgcggcgatgagtcagtgggggcccagggcgatccttgtccagacggacagcaccaaccggaatgccgatggggactggcaagcggccgtagctattcgcgggggcggagtcgttcaactgaacatggtcaacaaacgcgccgtggattttaccccggcagaatgcggggactccgaatgggccgtgggccgcgtctctctgggcctgcgaatggcaatgccgcgggacttctgcgcgattattcacgcccccgcggtatccggccccgggccccacgtgatgctcggtctcgtcgactcgggctaccgcggaaccgtcctggccgtggtcgtagccccgaacgggacgcgcgggtttgcccccggggccctccgggtcgacgtgacgtttctggacatccgggccacccccccgaccctcaccgagccgagctccctgcaccggtttccgcagttggcgccgtccccgctggcagggttacgagaagatccttggttggacggggcgctcgcgaccgccgggggggcggtggccctgccggccagacggcgcgggggatcgctggtctacgcgggcgagctaacgcaggtgaccaccgagcacggcgactgcgtgcacgaggcgcccgcctttctgccaaagcgcgaggaggacgcaggctttgacattctcatccaccgagccgtgaccgtcccggccaacggcgccacggtcatacagccgtccctccgcgtattgcgcgcggccgacggaccagaggcctgctatgtgctggggcggtcgtcgctcaatgccaggggcctcctggtcatgcctacgcgctggccctccgggcacgcctgtgcgtttgttgtatgtaacctgaccggagtcccggtgaccctacaagccgggtccaaggtcgcccagctgctcgtcgcggggacccacgccctcccctggatcccccccgacaacatccacgaggacggcgcattccgggcctaccccagaggggttccggacgcgaccgccaccccccgagacccgccgattttggtgtttacgaacgagtttgacgcggacgcccccccaagcaagcggggggccggggggtttggctccactggcatctagaccgcgcctcgcgtcgggccagatggggccccggtcaataaagagctctgtttcgcatatgccctggtgttggcggttttttttgttgtctgtctgcccggcgctcggttgtccgttctgtcgtcgctatcacatacgcacaaacacacgggtagagtggaaccgaaaccggtcgacgtttattcaccacacagaaacacaagctaagcgagaaggaggggggcctcggtcgacgaggcctggcgtttgggggcggacgtgcgatgacgtgggtccggtgtagggtccgcggggggcacgggcccggggcgaacgggggatctgtcgccggcgtgggtgactgggaccgacgcaacctccggggcttgtgccctcgtaggcccggggggggcctcggtcgctccaagccccgcggtgcgggtccctccggccagagccgaggtggagagaccaagggcccgctccgcgatcgccacgtcctccatgaccacgtcgctctcggccatgctccgaatggcctgggagacgagcacgtccgccgacttgtccgcggcccccaccgacatgtacatctgcaggatggtggccatgcacgtgtccgccaggcggcgcatcttgtcccgatgcgccgcaacggccccgtcgatggtggagccctcgagtcccgggtggtggcgcgccagcctctcgaggttgaccatgcaggcgtggtatgtgcgggccagggcgcgcgccttcacgaggcgccgggtgtcgtccagcgactctagggcgtcgtcgagcgtgatgggggcgggcaaaagcgcattgaccaccgccagggcctcctgcagccgcggctccgcctccgagggcggagccgcggcccgaatcatctcatattgttgttcctcggggcgcgttccccaaccgcacagcaccccgagcagggacgccatcccggaacacgcgcgcggctctgcgccggctttcccccaccccaccccctccgggttcgcaggggcgatggggacggaagactgcgatcacgaagggcggtcggttgcggctcccgtggaggttacggcgctgtatgcgaccgacgggtgcgttatcacctcctcgctcgccctcctcacaaactgcctgctgggggccgagccgttgtatatattcagctacgacgcgtaccggtccgatgcgcccaatggccccacgggcgcgcccaccgaacaggagaggttcgaggggagccgggcgctctaccgggatgcgggggggctaaatggcgattcatttcgggtgaccttttgtttattggggacggaagtgggcgtgacccaccacccgaaagggcgcacccggcccatgtttgtgtgccgcttcgagcgagcggacgacgtcgccgtgctccaagacgccctgggccgcgggaccccattgctcccggcccacgtcacagcaactctggacttggaggcgacgtttgcgctccacgctaacatcatcatggctctcaccgtggccatcgtccacaacgcccccgcccgcatcggcagcggcagcaccgcccccctgtatgagcccggcgaatcgatgcgctcggtcgtcgggcgcatgtccctggggcagcgcggcctcaccacgctgttcgtgcaccacgaggcgcgcgtgctggcggcgtaccgccgggcgtattatgggagcgcccaaagccccttttggtttctgagcaaattcggcccggacgaaaagagcctggtgctggccgctaggtactacctactccaggctccgcgcttggggggcgccggagccacgtacgatctgcaggccgtgaaagacatctgcgcgacctacgcaatcccccacgacccacgccccgacaccctcagtgccgcgtccttgacctcgttcgccgccatcactcggttctgttgcacgagccagtactcccgcggggccgcggccgctgggtttccgctgtatgtggagcgccgcatcgccgccgacgtacgcgagaccggcgcgctggagaagttcatcgcccacgatcgcagctgcctgcgcgtgtccgaccgggaattcattacgtacatctacctggcccactttgagtgcttcagccccccgcgcctggccacgcatctccgggccgtgaccacccacgaccccagccccgcggccagcacggagcagccctcgcccctgggtcgggaggcggtggaacagttcttccggcacgtgcgcgcccagctgaacatccgcgagtacgtaaagcaaaacgtcacccccagggaaaccgccctggcgggagacgcggccgccgcctacctgcgcgcgcgcacgtatgccccggcggccctcacgcccgcccccgcgtactgcggggtcgcagactcgtccaccaaaatgatgggacgtctggcggaagcagaaaggctcctagtcccccacggctggcccgcgttcgcaccaacaacccccggggacgacgcggggggcggcactgccgccccccagacctgcggaatcgtcaagcgcctcctcaagctggccgccacggagcagcagggcacgacgcccccggcgatcgcggctctcatgcaggacgcgtcggtccaaacccccctgcccgtgtacaggattaccatgtccccgaccggccaggcgtttgccgcggcggcgcgggacgactgggcccgcgtgacgcgggacgcgcgcccgccggaagcgaccgtggtcgcggacgcggcggcggcgcccgagcccggcgcgctcggccggcggctcacgcgccgcatttgcgcccggggccccgcgctccccccgggcggcctggccgtcgggggccagatgtacgtgaaccgcaacgagatcttcaacgccgcgctggccgttacgaacatcatcctggatctggacatcgccctgaaggagcccgtcccctttccccggctccacgaggccctgggtcactttaggcgcggggcgctggcggcggttcagctgttgtttcccgcggcccgcgtagaccccgacgcctatccctgttattttttcaaaagcgcctgtcggccccgcgcgccgcccgtctgtgcgggcgacgggccctcggccggtggcgacgacggcgacggggactggttccccgacgccggtggtcccggcgacgaggagtgggaggaggacacggaccccatggacacgacccacggccccctcccggacgacgaggccgcgtacctcgacctgctacacgaacagataccagcggcgacgcccagcgaaccggactccgtcgtgtgttcctgcgccgacaagatcgggctgcgcgtgtgcctaccggtccccgccccgtacgttgtgcacggctccctgacgatgcgtggggtggcgagggtgatccagcaggcggtgctgttggaccgcgacttcgtggaggccgtagggagccacgtaaagaactttttgctgatcgatacgggcgtgtacgcccacggccacagcctgcgcttgccgtatttcgccaagatcggccccgacggctccgcgtgcggccggttattgcccgtcttcgtgatcccccccgcgtgcgaggacgttccggcgttcgtcgccgcgcacgccgacccgcggcgcttccactttcacgccccgcccatgttttccgcggccccgcgggagatccgcgtcctccacagcctgggcggggactatgtcagctttttcgagaagaaggcgtcgcgcaacgccctggagcactttgggcgacgcgagaccctgacggaggttctgggccgctacgatgtgcggcccgacgccggggagaccgtggaggggttcgcgtcagaactgctggggcgaatagtcgcgtgcatcgaggctcactttcccgagcacgcgcgggaatatcaggccgtgtccgttcgccgggccgtcattaaggacgactgggtcctgctgcagctgatccccggccgcggcgccctgaaccaaagcctctcgtgtctgcgcttcaagcacggcagggcaagtcgcgcgacggcccggacctttctcgcgctgagcgtcgggaccaacaaccgcctatgcgcgtccctgtgtcagcagtgctttgccactaaatgcgataacaaccgcctgcacacgctgtttaccgtcgatgcgggcacgccatgctcgcggtccgctccctccagcacctcacgaccgtcatcttcataacggcctacggcctcgtgctcgcgtggtacatcgtctttggtgccagtccgctccaccgatgtatttacgcggtgcgccccgccggggcgcacaacgataccgccctcgtgtggatgaagataaaccagacgctgttgtttctgggcccgccgaccgccccccccggcggggcatggaccccccacgcccgcgtctgctacgccaatatcatcgaaggtcgggccgtgtccctcccggccatccccggcgccatgagccgccgggtcatgaacgtgcacgaggccgtaaactgcttggaggccctctgggacacccagatgcgcctggtggtcgtcggttggtttctgtatctagcgttcgtcgcccttcaccaacgacgatgcatgttcggcgtcgtgagtcccgcgcacagcatggtggccccggcgacctatcttttgaactacgccggccgcatagtgtcgagcgtgttcttgcaatacccctacacgaaaatcacccgcctcctctgcgagctatccgttcaacgccagaccctggtgcagctgttcgaggcggatccggtcaccttcttgtaccaccgcccggccgttggcgtcatcgtgggctgcgagctgctgctccgcttcgtggccctcggtctcatcgtcggcaccgctctcatctcccggggcgcctgcgcgatcacacaccccctgtttctaacaatcaccacctggtgtttcgtgtccatcatcgccctgacggagctgtatttcatcctgcggcggggctcggcccccaaaaacgcggaaccagcggcccccagggggcgctccaaagggtggtcgggcgtctgcgggcgctgctgttccatcatcctctccggtatcgccgtgcgcctgtgctatatcgccgtcgtggccggggtggtgctcgtggcgcttcgctacgaacaggagattcagcggcgcctgtttgatctgtgacgtaacgcctcttccgttggaagaggcggacccagtcgcccatgcaaattaaatacacgacccgcctcgggcctacgcaccctcgcacgtcgcatgcaaattaaaatcgtgcacagagccgatccggcctcgggtctgcttgcccctcccccggcccagcacaggcaggctcgtccgacttccgcatacaccccaccctaccgcgtgcttccgcacccccgcctacgcgtgtacgcgaaggcggacccagacctgccgtatgctaattaaatacataaaacccaccctcggtgtccgattggtttctggggacggcgggggcgggggcggtgacgcccgacggggagggacaaggaggagtttcggaaagccggccccggtcgtgcgggtataagggcagccaccggcccactgggcgctgtgtgctgccgtgtgccgaccccggttgcgcgtcggtgccgctcctcgattcggacccggccactctcttccgacacgcgccccctcggaggacacccgccatcccagccccggcgacctacaacatggctaccgacattgatatgctaatcgacctaggattggacctgtccgacagcgagctcgaggaggacgctctggagcgggacgaggagggccgccgcgacgaccccgagtccgacagcagcggggagtgttcctcgtcggacgaggacatggaagacccctgcggagacggaggggcggaggccatcgacgcggcgattcccaaaggtcccccggcccgccccgaggacgccggcacccccgaagcctcgacgcctcgcccggcagcgcggcggggagccgacgatccgccacccgcgaccaccggcgtgtggtcgcgcctcgggaccaggcggtcggcttccccccgggaaccgcacggggggaaggtggcccgcatccaacccccgtcgaccaaggcaccgcatccccgaggcgggcggcgaggtcgccgccggggccggggtcgatacggccccggcggcgccgactccacaccaaacccccgccggcgcgtctccagaaacgcccacaaccaagggggtcgccaccccgcgtcggcgcggacggacggccccggcgccacccacggcgaggcgcggcgcggaggggagcagctcgacgtctccgggggcccgcggccacgaggcacgcgccaggccccccctccgctgatggcgctgtccctgacccccccgcacgcggacggccgcgccccggtcccggagcgaaaggcgccctctgccgacaccatcgaccccgccgttcgggcggttctgcgatccatatccgagcgcgcggcggtcgagcgcatcagcgaaagctttggacgcagtgccctggtcatgcaagacccctttggcgggatgccgtttcccgccgcgaacagcccctgggctcccgtgctggccacccaagcgggggggtttgacgccgagacccgtcgggtttcctgggaaaccctggtcgctcacggcccgagcctctaccgcacattcgcagccaacccgcgggccgcgtcgacagccaaggccatgcgcgactgcgtgctgcgccaggaaaatctcatcgaggccctggcgtccgcggatgagacgctggcgtggtgcaagatgtgcattcaccacaatctgccgctccgcccccaggaccctatcatcggaacggcggccgccgtgctggaaaacctcgccacgcgcctgcgcccctttctgcagtgctacctgaaggcccgaggcctgtgcgggctggacgacctgtgctcgcggcgacgcctgtcggacattaaggatattgcctcctttgtgttggtcatcctggcccgcctcgccaaccgcgtcgagcgcggcgtgtcggagatcgactacacgaccgtgggggttggggccggcgagacgatgcacttttacatcccgggggcctgcatggcgggtctcattgaaatactggacacgcaccgccaggagtgttccagtcgcgtgtgcgagctgacggccagtcacactatcgcccccttatatgtgcacggcaaatacttctactgcaactccctattttaggcaagaataaacatattgacgtcaacccaagtggttccgtgtgatgttcttggcgcgcgcggcgggtggggcggagactccggggcgatgccggcgtgcgcgtgggaggagggcgatgacccaccggataaatgtggggccccggcccggcccgcttcatagcgcgtccaggaactcacggcagacgcgtattcaccgacccccccctcgcaacatgacaacgacgcccctctcgaacctgtttttacgggccccggacatcacccacgtcgcccccccgtactgtctgaatgccacgtggcaggccgaaaacgccctgcacacgaccaaaacggaccccgcgtgcctggccgcgcggagttatttagtccgcgcctcctgctcgaccagcggccccatccactgttttttctttgcggtgtacaaggactcgcagcactcccttccgctggttaccgagctccgcaacttcgcggacctggtcaaccacccgcccgtcttgcgcgaactagaggataagcgtggggggcggctgcggtgcacgggcccattcagctgcggaaccatcaaggacgtctccggtgcatcccccgcgggggaatacacgataaacggtatcgtgtaccactgtcactgtcggtatccgttctccaaaacctgctggctcggggcatccgcggccctacaacaccttcgctctataagctcaagcggcacggccgctcgcgcggcagaacagcgacgccacaaaatcaaaatcaaaatcaaggtataacccacccccttccctccgagtccgtatgcaacctcattaataaagagtgagaaccaaccaaaacagacgcggtgtgagtttgtgggttataggaacccggtaaataccacgcgacgaaccagcatgtgtgttaacgcaacttttattcgttgtatcgcgggaggggggaagcttaccgccaaaggaaggccaagatgataacgacgaccaccgcgaccaccccaaaaaccgcatgacgacacgtcccgccacaccaccctggggcttggggcgtgtcggagctcgacgcacagcgggccgcgcgttgggcccggtacagctctcgcgaattgacaagcgggggtcgccacgtgcgcgagctttgcacgcggggttggtcggccggccccacggacccgcccggtggctcggtcggacatgcggccatgaccatggcgtaggtgggggggcgatccgaggtcgcctctgcgtaagtagggaggcccgacgggaggtcgcctcccacgccagggtgggccccaatcatagtttccggtagaaacaggggggtctccacaaacaacccccctgggccaaagctccggcgccgcgcccgtcgttcggcgcggcgcctggcgcgccgagcggcccgccaggcggcgcggcgcgagcggccacgctcacacacctcgccgtcaccggaagaagccggtgaaacaagcccaaccggcgacgtccctgcagagtacggtggaggcgagtccgtgggggtgtcgatatcaataacgacaaactggcccgcgctcgcgccggccacactctcgtatgggggcggggcgtcaatcacgctatcatctccgtcatccctgcatgcgtgggcatgcccagcccccaacgccatggtggggattcgcggctcagaagcctgcatgtcgtgtggtcggtcgtagtccaacgtgcctcccccacccaccacacagccggtccccacgccgaccactagaccgcagacgtcgcccaaccgaggtccccgtgcacagaccgcgccttttatagccccaggggttgctaattaacgcacgcatgcagacgcaatttattttgctcccccgcgtcctcccctcccctgcgcacacgtgataggtcttgggaacccgaggggcgacgcggggaaagcgcgcccccgcccggccgccgcgcgcccccgcccggccgccgcgcgcccccgcccggccgccgcgcgcccccgcccggccgccgcgcgcccccgcccggccgccgcgcgcccccgcccggccgccgcgcgcccccgcccggccgcccgcgtcgcgccggcgccccctcccggcgcttccggggtctttccttccttccccgccgcgaccccggccccgccccaccgccccgcccggcaggggggccccggcgccgcgcagaacacacagacgaacacacggtggcgatcttttctttacttcggcggaccagcgagccccggccccggcccgcgccccgccgccacacccacggcaccccccccccgccgcccaccccggggtccacacaggagcgcgcgggcggcagaaacgcgggcgcggcggcggtcggggtgggagtggtggtgggggacacgaaaacacacccacgacactctccccccaccccgaccgccgccgcgccccaccggcgggatcgcggcgagacgcagccgggcccccccccaccacccgcccacccacctaccccgcgcccgcagcctccggcagcacgccgaccaccgccgccaccccccaaacagccaaggcgcggtggggggcgtggtggtgaacgatggggggaacacgggggggaggggtccggggcgaggcgggcgggcgaaggaagggggggtggtggcggcggcggtggaaagcggaaaaacggaggatggaagggcagaagatggggagtcccgatcctcctcctgcatcccctcgccttccattctccggccctccgcgagtcccgacgccccccccccgccgcccgacgaaggagacccaagcaccgcagccggagaggccgagcggggagtgggcggccgggcgggaggatggcggagagagagagagagagagagagagggggggggggggagagggaaagcaacgggaaagagaggcgcgcggaaaagcagcaagaggggggacggggcgagccgggcagagtgcggagcccccggagcccgcggccgcagccgagcagcgccgcgggctccggggccgggccgggccggcaacgccccgcgccggccgcggcggagagaacccctgtgtcattgtttacgtggccgcgggccagcagacgggccgcgggccagcagacgggccgcggcgccagcggcccacgcctcccgccgcattaggcccccgcgggcatccggcggccggccccacgcccttccattaaacactcccacgttgggggggggcgcgccagctgagtgctctgcggttgcgggcgccgtgcccggagatccattaagccgccggagagcccgagccccgcccgcgtgttgctgtgggcatttctgctgcgtcatccctgtctttataaaaccgggggcgcggcagcaacgaacgcaggggcccgccgccgatcgagagggactccggagaaggaaggctgctccgcgcaccggcgcgcccttctcctctcccctccctacctccccctctcttcccccttttttcccccgcctcccgtcttcttccgcgcctccgagggtccgcctctgcctcggggacccccgggcgggccggggcttggccgccgaggtgcgccccggccggaggggcccccgcacctcggcggccgccccctccggcgccgcgcgttcgcgaaaggcgcgaaaggggcccccggaggcttttttcgattcccggccgggggtcccgggtagccgcccggcgccgggcggaaggcgtcccccgcccggcggtccggcccgggcccccggcggagcgcgggggccccggggccccgggccgcgccggcggcgtttccgcgttccgtttcttctccctcccggccgccccgctcccgggcccgaccctcgccccttcccttctcctcgtcttcccccgtcccgccgcgccccttccctcttccttctctctctctgtctcgctctcctcacatttcccccccccccccgccgccgccgccctctgcccgcgtcccaccgagacgccgcgccgcgtgagccgtccgccgggggacccaggctccggggggggggggcgcctgcgtgtgtctcgtgtgagagagcgcgcccctcgaacgccgcgcgttctcgcaggtaggtttagggtcgtacaggtgagcttctgctgaggcggcgggagagggggggggggcgggcggaagagagaagagagcaggggttgggggagaactgttcttcctccccctttcaagaaacacgaggcgggggtcccagaaagggcaggcaggtcagccgcaccgcccgcgagccaacccgtatcctttttttctaggtgtttttgtttttgtttctgtttttgtttgttttgttattattttcgcggatccggcgtgttcggatccaccccccctttctccttcctcttcccttccacccacccccgtttcccccccccgtggtgtcgtccgggggcgtcgttcccagggggggcaggcgcgggtcgggcccatacgcccaccgcccccacgcgccggtcacccccccccaacaaccccaaaggcgcgtgcccagccacagccgtgggtgtggcgcccgtccccttcctctaccgcgtgggcgcgggcgggggggtggtggtagtggtggcggaaggaaacgggccgggggccggggccgctagggaaaggtaggcacgcgcgcggtgtgtcgacttgcatgccccgcaaaacgcgtcgtgtcgtgttgtgtcgtggtgggccgtgttgtggtgggccgtgtggtgtggtgtggtgttgcgaacgcgcgagccccctcgccccgatgggagtctccccgcagccagggtaaggaggggcgggcgtggcgggcaggtgtgcgggcggggtggggtgagtgcggttgcatgcctcgggtctcctcttcctgctcctcctcctttctcccagccagggtgaggaggggcgggcgtggcgggcaggtgtgcgggcggggtgggcgccggggcgggggtgggcacgggcgtaagtgcgggtgcatgcctcgggtcttctcttctccctcctccttcctcccacccgtccccgggggcagagggcgtgcatgcgttgtgattcaaccgccctcgcccccgccccactttccccccctctctatcaaagttccctggcccctggcttcgcgccggtggtgcggctgaccccccccctcctccctccccgagccaggcgccctcccactcctgcccaccacccccagggtctggccggccagacgtgcgtgctctgcacgatcgggcccccctccctgtcaacacggacacactctttttttacccgccagccagcccgcccacccaccaagacagggagccagaacgcaggccgggccccggctctgttctatcataaagaccaacaggcctcgggggtgggggcggcttctcgtgcccgccccccctcctcctcctccctttccccccccccatccccggcccccctgcgcgggggagctgcatcaaaggccaacaacaaagtgtgtcaaaagcatcacaaaactttattgtaaaatttttataaatataaagttttttttcctcaagttttcaacaaggccagaaagtccataacaaaatgctggtgtgtgttgctgttcggggccgtgtccgtccccccccactcccacccccacttcctgtctcctccccgtctttcccccccacctccccctgcccccgaggcgcctcggccggtggtccggtggggggcggcttccctttgggcagcaagccgagtgttagctccccctactccccgtggcccgcgggggcgtcgccggccggcgcgggcgcgccctgctcccgagaccacgggtggcgcgaccggaggccgtggaagtccagcgcgcccaccagggtgccctggtcaaagagcatgttgcccaccggggtcatccagaggctgttccactccgacgcggggggcgtcgggtagtcggggggcctcacgcagttgcgcgcgtgctcggggagcagggtgcggcggctccacgcgggggccgcggcccgcagcaggtccgccacgttccccgtctggtccacgaggaccacgtaggcccctatgtggcccgtctccatgtccaggacgggcaggcagtcccccgtgaccgtcttgttcacgtaaggcgccagggccacgacgctcgagacccccgcgatgggcaggtagcgcgtgaggccgggcgccgggtcgcgggccccgggctcggggccgccctccgcgtggcgcgtcttcctggcacacttcctcggcccccgcggcgcagcagcgcgggggccgagggaggtttctcgtctctccccagcgccggacgcggacgcgacgctcccaccagccccgcccgcagaggaagaggcggaggaggaggaggaggaagaggaggcggcggaggaggaagaggcggcggaggaggaagaggaggcggcggaggaggaagaggaggcggcggaggaggaagaggaggcggcggaggaggaagaggaggcggcggcggcgaccgcggcctgggacgacggagacgccgacgggggcgcggcgcccgcggacgccggggcgagcggcccgtggccgcggtcgcccgagtccgagtccggggcccggcgcggcgccgccctcttggcccccaccccctggggggcgaggggcgagcgcggggcggcggaggaagaggcggaggacgaggccgcagggcccgagtccgacccgcgcctcttccgggggcgggccgccgccccctccgcggcgtggggggcggcaccgggggtgttggtgccgcgggggaccccgggtcctccctccgcgcccggccctcccgacccgcgcgcgtcggtcgcgcctgcccggcccagactctgtgcttgggtgtcggtctgagcctgggtcatgcgcgaccggggcgcgcggtgcgcgtccaccggcacggcgggcggcgcgggcccggccgcgtccgcgctcgcagacaccacgggggcggcggcggcgcggggcggactccggacgcgcggggcgacggccgcgcgggggcgcgccgcgcgccccgacgactgtggcagacctccccccccggggcccgaggacacctgcgcggaggaggaggagaaaaaggagagcggcccggggcccgcggggcggcgcggagacggcgggggagagtcgctgatgactatggggggctcctgggccgcgcggggctgtcccgcggggggcgtcctgccctccgccgccgcggcgtcttcgcccacccgccgcgcctgcgcgcgccccccgccggccgcagggggaagagaggccactctcggcacgacggccgcgacggcagggccgcccccagacccagatcccacccccgcccgcaacggggcgccgccgctgctgctgctccgcggggcgccagggggcgccggtcgggtcgcggcgggctgggaggttccgcgggtcgcccccgcaccgccgcccccgcgccggggcgctcttcggggggcgggcgggacgtagtccactgcagagggagacagagacgggagcccccggttagtgcccgacccccgcccgacccccgcccgacccccgcccgacccccgcccgacccccgcccgacccccgcccgacccccgcccgacccccgcccgacccccgcccgacccccgcccgacccccgcccgacccccgcccgccctcaccgtcggccaggtcatcgtcctcgtcgtccgtgccgggccacgggggggtgggcgacagggcgcggaccgtgtgtccccccagcgacagggagcgcggggccgtccgctggttgcccgtccagataaagtccacggccgtgccggcccgcacggccgcctcggcctccacgcgggtccgggggtcgttcactatcgggatggtgctgaacgacccgctggcggtcacgcccactatcaggtacgccaccggggtgttgcacaggggacacgtgttgcgcaacggaatccaggtcttcatgcacgggatgcagaaggggtgcaggcagggaaaactctggcagcgcaggggcggggcgatctcgtccgtgcacacggcgcacacgtcgcccccccctcccgcttccgcttcctcctcacccacgggcccacccccgcaggatccctgcgcgtcggcgggcgtggggctgccctggcgctcggccgggggccgggccgggggcgtggccgcgtccatcaggcccgcctcgaacatctccgtgtccgtgctgcccgcctcggaggtggagtcgcggtgaaggtcgtcgtcagagattcccacctcggtctcctcctccgagtcgctgctggcgagccactgcatgtcgttgagcatcccccaggcgtgcggggcggcgggctgcttgacaaagcaacgggggggatttagagggcgcggggcgtgaggcgggacccccgcgccgtgtcccccgtgtccctccctcaccccggccccccgcccgctgctttttgttcggaagggggggagaaaggggtccgtaaccaaaggtggtctgcgtcctttggattccgacccctcgtctccccccctgtcccccgctctcgggctcctccctgcctccctcgcccccccagagggtcggggggcggcgcacggcccacgggggtcccccgaccgcttaagcgggccgggggtcggccccgtcaagcgtccccgcccccgagcccaccgcccgcgaccacccccaacccgcagccgggtggtccggggaaaagggggggcctgagacccgggggtcgccctctcaccgtgccgggggtctgccgcggcggccgctcggggccggggtccgcccgggagctcgtgccgggccggggttccatgagccggggtagggtagactcgagacggcggcccgcggtctctctcttgccgggttttagtctctgtctctccgggtctcctcctcccgccgggccgccgctccgtcgctcgcagtgccggggtgcgaatgcggcccgaccgtcacacggggctgccttatacccggcgcctatccactcccccaaaggggcggcatttacgattcccccaatagccgcgcgccccggcgggggcggagggagggaatccccccctctcggggcggccccgtccccggggaccaaccgggtgtactccaagaaccccattagcatgcgccgccccccgccgacgcagatgggagtccccccggcgccccgccggcgcggccctgagtggtgcccgcccccggggagaaattcattagcatactaggaagcccaggggaccaataggggccgatcagcccacccacccggcggcgcgcgaggctctgcgtgttctgccaagaaagtaatcagcataacccggaaccccgagggagtaattacgcggggagcgaggggccgtccgaacgtttttaattaccataagcgggaatggcggcccgttaaaagctgctaattaccgcgagcgggaacgccggcccattaaaagttgctaattaccatgcgcggggatggcggccgggaccgcctattaaaagtttctaattaccataccgggaagccggtctagaggatccccgggtaccgagctcgaattcatcgatgatcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggatccatgcaggtgcagctggtgcagagcggcgtggaggtgaagaagcccggcgccagcgtgaaggtgagctgcaaggccagcggctacaccttcaccaactactacatgtactgggtgcggcaggcccccggccagggcctggagtggatgggcggcatcaaccccagcaacggcggcaccaacttcaacgagaagttcaagaaccgggtgaccctgaccaccgacagcagcaccaccaccgcctacatggagctgaagagcctgcagttcgacgacaccgccgtgtactactgcgcccggcgggactaccggttcgacatgggcttcgactactggggccagggcaccaccgtgaccgtgagcagcgccagcaccaagggccccagcgtgttccccctggccccctgcagccggagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagcgggtggagagcaagtacggccccccctgccccccctgccccgcccccgagttcctgggcggccccagcgtgttcctgttcccccccaagcccaaggacaccctgatgatcagccggacccccgaggtgacctgcgtggtggtggacgtgagccaggaggaccccgaggtgcagttcaactggtacgtggacggcgtggaggtgcacaacgccaagaccaagccccgggaggagcagttcaacagcacctaccgggtggtgagcgtgctgaccgtgctgcaccaggactggctgaacggcaaggagtacaagtgcaaggtgagcaacaagggcctgcccagcagcatcgagaagaccatcagcaaggccaagggccagccccgggagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagccggctgaccgtggacaagagccggtggcaggagggcaacgtgttcagctgcagcgtgatgcacgaggccctgcacaaccactacacccagaagagcctgagcctgagcctgggcaagggcagcggcgccaccaacttcagcctgctgaagcaggccggcgacgtggaggagaaccccggccccgagatcgtgctgacccagagccccgccaccctgagcctgagccccggcgagcgggccaccctgagctgccgggccagcaagggcgtgagcaccagcggctacagctacctgcactggtaccagcagaagcccggccaggccccccggctgctgatctacctggccagctacctggagagcggcgtgcccgcccggttcagcggcagcggcagcggcaccgacttcaccctgaccatcagcagcctggagcccgaggacttcgccgtgtactactgccagcacagccgggacctgcccctgaccttcggcggcggcaccaaggtggagatcaagcggaccgtggccgcccccagcgtgttcatcttcccccccagcgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaaccggggcgagtgctaactcgagctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccaggttatccgtgtaaccgccagtccgtgcttgcctagcgaactcacccgtcccggctggcgtgcgcagcccgggccgtgttgcgggccctcttaaggggcggcggcaggacggggactcccgccccgcctcttttcccccggggagtcaacccccggggggggtgttttttgggggggggcgcgaaggcgggcggcggcggcgggcgggcggcagggcagccccgcgcgcccccttccccgtccctcccccggagccggccgctcccccgcgggcgccgcccctccccccgcgcgccgcggggctgccttcccgcgggcgcccccgcgcggcttttttcccgcgcccgcccccgcgcggcaagacggggactagcaggctgtgccgcagaccaccacacactcccaagctccccgcccccccgaagacgccagtcgcaccaccgctcgccctcgcagaccagacagttgcaccaagcacccgcccgcccgcacacggttccccgccaccccctccctcccctccatcccgccgagctcgcggcagcccctcccccccgcgcgccacggggctgcggtcccgcggccgcctcccccgcggccgcctcccccgcgccccgccccgggggcttcccccgcccctccccccgcgcccgcggccccgagctcgcagcagcccctccctcccgcgccccgtgccttccctcccgctcctgcgggggggctcgggccacctgaccttcgtaacctgcactcaggtcagagccccagaccccccgcgggcgcgggagacgtgccgcccacccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgaataaaccacacaaggcggtacgttttcgtctgtctcgttctttatttctcacacacgcgcgcggccatcgccgcgtctgtcttaaaggcgcacagacgcccgattccttccccctctccccatctcccccctcccccgctcccggaagtttcccccccgtcactccccaaacagtccgtcgtcgtcgtcctccagctccgcgtccatgtccacgggctcgcgcctcggcggcgtggccagccccgcggcggtccccaccacctccacgccgccgcccgccgcggccagcaccgtccccgcgcggcccgcggccgacgcccagcgtatctgcgggggcgggcccgcgtccgcgtcgtcgcgcagcaccagcgggggcgcgtcgccgtcgggctcgagcagcgcccgcgcgcagaactcccgccgcggcccgcgcagctccgccgggccgccgcgcacggcgtcgcgccccagcgccacgtagacgggccgcagcggcgcgcccaggccccagcgcgcgcaggcgcggtgcgagtgcgcctcgtcctcgcagaagtccggcgcgccgggcgccatggcgtcgcccgcgcccgaggcggcggcccggccgtccagcgccgggagcacggcgcggcggtactcgcgcggggacatgggcaccagcgtgtcggggccgaagcgcgtgcgcacgcggtaccgcacgttggccccgcggcagaggcgcagcggcggcgcgtcggggtacaggcgcgcgtgcgcggcctccacgcgcgcgaagacccccggcccgaacacgcggccggaggccagcacggtgcggcgcaggtcccgcgccgccggccagcgcacggcgcactgcacggcgggcagcacctcgcaggccaggtaggcgtgctgccgcgagaccacgggcccgtcggcgggccagtccgcggcgcgcacggcgttgacgacgatgaggcggcggtcgcaggcgccggccagcagccccaggaactccacggcgccggcgaaggccaggtcccgcgtggacagcagcagcacgccctgcgcgcccagcgccgagacgtcgggggcgccggtccagttgcccgcccaggcggccgtggcgggcccgcagagccggttgcccagggccgccagcaggcaggacagcccgccgcgctcggcggaccactccggggggggcccgcccccggcgcggcccgcggccaggtcctcgcccggcagcggcgagtagaggatcaccacgcgcacgtcctccgggtcgggcacctggcgcatccaggccgccgcgcggcgcagcgggcccgaggcgcgcagcgggccgaaggcggcgggcgcgccgccggggggcggggcggcgcagcgcgcggccagcgaggccagcgcgcgcgggtcgaacatgagggccgggcgccacggcgcggggaagagcgggtggtccgtgagctcggccacggcccgcggggcgcagtaggcctccagggcggcggccgagggcgccggcgtgtggctgggccccggcggctggcggcgccagccgccctgcgggtcggggccctcggcgggccggcgggtcagcgccgcggggcgcggcggccgcggcggcggcgtcggcggggcggggggcgcggcccccgcgggaggggcggccgcggggcggggggcgtccgcgcggctcttcttcggggggcgcggggcgccgcccggcggcgccctggccggggcggggctcttgcgcttgcgcgcctcccgcggcgcggaggcgggcgcggcgagcgagtcggccgcggcgacggtgtcggccagcagggggcgcaggctctggttctggaagagcaggtccgcggcggcggcggcggcggagctcagcaggcgcgggctccgcggcagcgccgggcccagggccccggcgaccaggctcacggcgcgcacggcggccacggcggcctcgctgccgccggccacgcgcaggtccccgcgcaggcgcatcagcaccagcgcgtcgcgcacgaaccgcagctcgcgcagccaggcgcgcaggcggggcgcgtcggcgtgcggcggggcggccgcgcccgcgggccccgggcgcgggggcgcggcgggccgggctccggccagccccggcacggccgccaggtcgccgtcgaagccctccgccagcgcctccaggatcccgcggcaggcggccaggcactccacggccacgcggcccgcctccgcgcgccggccgccgccaccaccgccggcgccgtcgtcgtcgtcgtcgtcgtcggccccggccggcgcggaggcgggcgcggcgctcaggcgccccagggcggcgagcacccccgcggcgccgtagccggcgggcaccgcgcgctcgtcggccggcgacgccgccgccgacggcaacggggcggcggcggcggcgggcttcccgcgggcgtcgtcgccgtcgtggcggttggcgtcgccgccgtcgtcgggggttcgcgccccggtcagcgccgcgttctcgcgcgccagcaggggcgcgtaggcgcggcgcaggctggtcagcaggaagcccttctgcgcgcggtcgtagcggcggctcatggccacggcggccgccacgtgcgccaggccccagccgaagcggcccgccgccatggcgtaccccaggtggggcacggcccgcgccacgctgccggagatgaaggagctgctgttgcgcgccgcgcccgagatccggaagcaggcctggtccagcgccacgtccccgggcgccacgcgcgggttctggagccaccccatcgcctccgcgtccggcgtgtacagcagccgcgtgatcagggcgtactgctgcgccgcgtcgcccagctcgggcgcccacacgggcgccggggcgcccgaggcctcgaaccgggcccgcgcctcctccgcctcgggcgccccccagaggccggggcggctgtcgcccagcccgccgtacagcacgcgccccgggggcggggggccggccccgggccacggctccccgctgacgtacccgtcgcggtagcgcgcgtagaaggcgccggaggccgcgtcggcgtccagctcgacccgccggggccgcccggccgtgaagcggcccgtggcgtcgcggccggccaccgccgcgcgggcccggcggcgctccaggcggcccgcggtcgccgcgggggtccgggccggggcgggctcggccctgggcgggctcggccggggcgccgcccccggggccctcgcgggcacccccgcctcctcgtcgtccgcgccgagggtcccgcccgcggcgtggtctgcggcgctggcgggggcgcgggcggcgtcgtcgtcgtcgtcgtcgtcagacgaggaggcggatgcagacgaggaggaggaggcggaggaggaggcggaggacgccgacgacgaggatccggattttgatgagtcagaggcggccgagcgccggcggggggcgcgccggcggcggtggtggtggtggtggtggtgtcggcggggcgccgggggtcgcggcgacaggctggccatggggtccgggtacgccccgcggaccgcggacgtcgtctccggtccgcggacccagcggcccgcgtcgcggtcgtcgtcatcgtcgtcgtcgtcgtcgtcgtcgttctcctcgccataatcggcgcgcatggagggggtccgcggcggagaaggcgagcgggccgcttcttcttccgcgccgtcgcgctccggggggggcgacgggatcgtgcgaacggcctcgtccaccatcgaggccagcagggccagctgccgcggcgagacgacgccgtccgcggcaggctcgtcgacggcctccccggacgccggggccgcctcgtcggcatcggcatcggcggcggcgtcgtcggcctcgtcttcgttctcctccggcccaccgtgccacccgaacccgggccgcgcggcggggcgacggtccgggttcggggtgggcggcggtccgtcggctggatccggagatccggggccgccggtcgtctccgccgcggcccggagacgtcccccgtcctcgtccgccatcgcgacctcggccccgcggccctgcgtcgtcgtcgtcgtcttcttcttcttccgctgctccgccgacatcgcctccgaccggggtgtgcgggggggggtcttcttcttcttcttcaggggcggcagtgggggggggtggttggcagtctctctcccccccgtgcggtgcgtgcgtgtgcctgtgtcttttcgcctctccgcgccgatcgggtagatcctggcggccgcgtcggtagccgcgctccgtgtggacgatcgccccgtcgcctggctgatatagtcctcggggcgcgcggggcggggggaaaggaggaggacgcggaggaggagcgatcgacgccgccgcgccccggctcgccggggttccgcccccaggtggaaccgcattatgcgcggccccgccccgacgcccgcgcgtccgcgtccgtggcggcggcccgttggtcgcgccgccgccggctccgcccgcgcggcatctcattagcgcccggcgcgggcggcttccgcttccgcccgcgatgctaatgagaccctcgtcgcgggcgggctcgctcccctgcccttccgggttcgtggtaatgagatgccggccccgcgctcccgttggcccccgccggccccaaaggggccggcgaggtcgccccgttggtccgcgggcggctccgccccaaagggggcggggccgcagggtaaaagaagtgagaacgcgaagcgttcgcacttcgtcctaatagtatatatattattagggcaaagtgcgagcgctggcgccctgcccggggcccgcgtcatcccgcgggctccgccccaaagggggcggggccgcagggtaaaagaagtgagaacgcgaagcgttcgcacttcgtcctaatagtatatatattattagggcaaagtgcgagcactggcgccctgcccggggcccgcgtcatcccgcgggctccgccccgaggcgggcccggacggggggcgggccgttcctcgcgcacataaagggccggcgtcccggtcgccgccgcaccaggggcacaccggctgcgcggcggagaccgggacggcagcggcggcatcgcgaagggggccacagcgagacagagacgccggcggcgagcggggcaccgacgcacccggatcggatcggatacagagacgcgggcgcatcggttccttttcgttctgcctttccctcccccccccccccccaccctgtacgtaccgcgaggacccatccacccactgcagccttatcgcaggtacggtgacccggggggccgggccggggggacgggccggggggacgggccggggggacgggccggggggacgggccggggggacgggccggggggacgggccggggggacgggccggggggacgggccggggggccggggggccggggggccggggggacggggggacgggccggggggacgggccggggggccggggggacggggggacggggggacggggggacggggggacggggggacggggggacggggggacggggggacggggggacggggggacggggggacggggggacggggggacggggggacgggccggggggacggggggacgggccggggggacggggggacggggccccgatcccaacatccgcgctttctcgcaggccgggcgccgccttcgtggacgggacaccggtgtggtaactggcgacaaggcgttgccactatggcagacatccccccggacccgcccgcgctcaacacgacgcctgcgaatcatgctcccccatccccacccccgggttcacggaagcgcagacgccccgtcctccccagctcgtcggaatctgagggtaagcccgacacagaatcggaatcctcctcgaccgagtcgtccgaggatgaggcgggagacctacgcggcgggcgccgtcgctccccgcgggagctcggggggaggtattttttggatctgtcggcagaatcgaccacggggacggaatcggagggaacggggccgtcggacgacgatgatgatgatgcgtcagacggctggttggttgacacacccccccgcaaatccaagcgaccccgaatcaacctgcgattaacgagctcccccgaccggcgtgcgggtgtggttttccccgaggtgtggagaagcgacagacctatccgcgcggcgcaaccccaggccccggcccagtcttccggggatcgcgcagccgcaccgcggcgctctgctcgccaggcccagatgcggagcggagccgcctggacgcttgatctgcattacatacgccagtgcgtcaaccagctctttcggatcctgcgtgccgccccgaacccgcccggcagcgccaaccgcctgcgccacctggtgcgagactgctacctcatgggctactgccggacccgcctggggccgcgcacgtggggccgcctgctgcagatctcgggcggaacctgggacgtgcgcctgcgaaacgcaatccgggaggtcgaggcgcattttgaacccgccgccgagcccgtgtgcgagctgccctgtctgaacgccaggcgttacggccccgagtgtgatgttggcaatctcgagaccaacggcggctcgacgagcgatgatgagatatcggatgcgacggactcggacgataccctcgcgtcccattccgacacggagggggggccctccccggccggccgggagaacccggaatccgcgtccggcggggctatcgcggctcggctggagtgtgagtttgggacgtttgactggacgtccgaggagggctcccagccctggctgtccgcggtggtcgccgataccagctccgccgaacgctctggcctacccgccccgggcgcgtgtcgcgcaacggaagccccagaacgcgaggacgggtgccgaaaaatgcgcttccccgccgcctgcccctatccctgcggccacacatttctccggccatgagcgcgggacccccagcccggtgtgtttgccaaacgaaaaataaacgccctacaagaaagcttttgtgtctgagtgtctggtttttctgggggtggaggaaggaacgacaaaaaaaagaaacaaacgcgacaccgctcgtacgtgtaatggggcgcagtgttttttattagcatcggggggggttagaggttggtgattggatagcaaacgtgggatgacggaggccactcgtcgccaacggccagcgggggcccggggttctgggggtcatcgtcccccgtctgccaggagggctcatcgggaatctcgggtcgccccatgcacgtaaaacacgggcgctgcgtggggtgggtcgccggatgcgggcgggatgatgcggggcggggtttgttgtgaggagccacgagggaccgtagccagcgaagacagctgcgttcccggtcgccgggcaccaccacgccgtattggtattcgtatcggctaaggagattttccagggggtgattaggcgctgcggggaacggggtccacgacacggtccgctcgggcaaaaaccgatcgggcaggggccacggttcccccacccacgcgtcgttggtcttcgtggcgatgaagcgaaaccccagccgggttttttgtgcgtactcgaaaaacggcacacacaggtccgccgccccgaccacccacaggtggtatagccggtgggggccggggcgctcttgatgcaggagccgaaaacacgcaggggcatccagaatctcgatgctttccagggggtcgtcctccgcaaacaggcccgtcgtggtgtttgggggacagcgacaggagcgggttcgcacgatcggtcgggtgaatttgggcaagtccatcagaggctcggccagcctgcgaaggttcgccgggcgaaccaccaccggggttcccagaggctcggaggccaggatccggcattgccgaagcagaaaactccacagagccgggcttgcgtcagcggaagtccgcggcagggcgtttcgttggtctaggagggtaaccacacttacaacaacaacgcccatgtcggtatattaggcccgtggtccgatcttcactcactcgcctgtctgcggacctatgcacggcgggacggcgcgcggacccgggggggctgcttgctatcacacggcccgttcgcacgttcgattttttcagccttgtttggttggctaggtatcccggataatctgacgttccggatatagggggcggggggtagtggggggtgtgtcgacaaactgccgcttcttaaaacaccggggcccgtcgctcggggtgctcgttggttggcacgcgcgacgcggcaaatggcctgtcgtaagttctgtggggtctaccgtagacccgacaagagacaggaggcgtccgtcccgccggagacaaacacggccccggccttcccggcgagcaccttttatacccccgcggaggatgcgtacctggcccccgggcccccggaaaccatccacccttcccgcccaccgtcccccggcgaggctgcgcgcctgtgtcagctgcaggagatcttggcccagatgcacagcgacgaggactaccccatcgtggacgccgcgggtgcggaggaggaagacgaggccgacgatgacgccccggatgacgtggcctacccggaggactacgcggaggggcgttttctgtccatggtttcggccgcccccctgcccggagccagcggccatcctcctgttccgggccgcgcagccccccccgacgtccggacctgcgacagcggtaaggtgggggccacggggttcaccccggaagagctcgacaccatggaccgggaggcacttcgggccatcagccgcgggtgcaagcccccttcgaccctggcaaaactggtgaccgggctgggattcgcgatccacggagcgctcatcccggggtcggaggggtgtgtctttgatagcagccacccgaactaccctcatcgggtaatcgtcaaggcggggtggtacgccagcacgagccacgaggcgcggctgctgagacgcctgaaccaccccgcgatcctacccctcctggacctgcacgtcgtttctggggtcacgtgtctggtcctccccaagtatcactgcgacctgtatacctatctgagcaagcgcccgtctccgttgggccacctacagataaccgcggtctcccggcagctcttgagcgccatcgactacgtccactgcgaaggcatcatccaccgcgatattaagaccgagaacatcttcatcaacacccccgagaacatctgtctgggggactttggggcggcgtgctttgtgcgcgggtgtcgatcgagccccttccattacgggatcgcaggcaccatcgatacaaacgcccccgaggtcctggccggggatccgtacacccaggtaatcgacatctggagcgccggcctggtgatctttgagaccgccgtccacaccgcgtccttgttctcggccccgcgcgaccccgaaaggcggccgtgcgacaaccagatcgcgcgcatcatccgacaggcccaggtacacgtcgacgagtttccgacgcacgcggaatcgcgcctcaccgcgcactaccgctcgcgggcggccgggaacaatcgtccggcgtggacccgaccggcgtggacccgctactacaagatccacacagacgtcgaatatctcatatgcaaagcccttacctttgacgcggcgctccgcccaagcgccgcggagttgctgcgcctgccgctatttcaccctaagtgaccccgctccccccggggggcgtggaggggggggctggttggatgtttttgcacaaaaagacgcggccctcgggctttggtgtttttggcaccttgccgcccggcgtcatgcacgccatcgctcccaggttgcttcttctttttgttctttctggtcttccggggacacgcggcgggtcgggtgtccccggaccaattaatccccccaacagcgatgttgttttcccgggaggttcccccgtggctcaatattgttatgcctatccccggttggacgatcccgggcccttgggttccgcggacgccgggcggcaagacctgccccggcgcgtcgtccgtcacgagcccctgggccgctcgttcctcacgggggggctggttttgctggcgccgccggtacgcggatttggcgcacccaacgcaacgtatgcggcccgtgtgacgtactaccggctcacccgcgcctgccgtcagcccatcctccttcggcagtatggagggtgtcgcggcggcgagccgccgtccccaaagacgtgcgggtcgtacacgtacacgtaccagggcggcgggcctccgacccggtacgctctcgtaaatgcttccctgctggtgccgatctgggaccgcgccgcggagacattcgagtaccagatcgaactcggcggcgagctgcacgtgggtctgttgtgggtagaggtgggcggggagggccccggccccaccgcccccccacaggcggcgcgtgcggagggcggcccgtgcgtccccccggtccccgcgggccgcccgtggcgctcggtgcccccggtatggtattccgcccccaaccccgggtttcgtggcctgcgtttccgggagcgctgtctgcccccacagacgcccgccgcccccagcgacctaccacgcgtcgcttttgctccccagagcctgctggtggggattacgggccgcacgtttattcggatggcacgacccacggaagacgtcggggtcctgccgccccattgggcccccggggccctagatgacggtccgtacgcccccttcccaccccgcccgcggtttcgacgcgccctgcggacagaccccgagggggtcgaccccgacgttcgggccccccgaaccgggcggcgcctcatggccttgaccgaggacacgtcctccgattcgcctacgtccgctccggagaagacgcccctccctgtgtcggccaccgccatggcaccctcagtcgacccaagcgcggaaccgaccgcccccgcaaccactactccccccgacgagatggccacacaagccgcaacggtcgccgttacgccggaggaaacggcagtcgcctccccgcccgcgactgcatccgtggagtcgtcgccactccccgccgcggcggcggcaacgcccggggccgggcacacgaacaccagcagcgcctccgcagcgaaaacgccccccaccacaccagcccccacgacccccccgcccacgtctacccacgcgaccccccgccccacgactccggggccccaaacaacccctcccggacccgcaaccccgggtccggtgggcgcctccgccgcgcccacggccgattcccccctcaccgcctcgccccccgctaccgcgccggggccctcggccgccaacgtttcggtcgccgcgaccaccgccacgcccggaacccggggcaccgcccgtacccccccaacggacccaaagacgcacccacacggacccgcggacgctccccccggctcgccagcccccccaccccccgaacatcgcggcggacccgaggagtttgagggcgccggggacggcgaaccccccgaggacgacgacagcgccaccggcctcgccttccgaactccgaaccccaacaaaccaccccccgcgcgccccgggcccatccgccccacgctcccgccaggaattcttgggccgctcgcccccaacacgcctcgcccccccgcccaagctcccgctaaggacatgccctcgggccccacaccccaacacatccccctgttctggttcctaacggcctcccctgctctagatatcctctttatcatcagcaccaccatccacacggcggcgttcgtttgtctggtcgccttggcagcacaactttggcgcggccgggcggggcgcaggcgatacgcgcacccgagcgtgcgttacgtatgtctgccacccgagcgggattagggggtgggggtggggggcgagaaacgatgaaggacgggaaagggaacagcgaccaaatgtcacgataagaacaataaacctgtgacgtcaatcagatatgtgagtttggttgtgttttgtgggactgggggcggggggtgggaggtatcagtgggtgacagagtcttttaaaagacgtgtcccggggccctcgagacgcgcaacttttggccacacagagaaaggcccccagacgaagtcacccgggtccccgaacaaaaacaaaaaccttgaccgccgccggggggcgtgcctgttgttttggtctcaatggatcggtatgccgttcggacctgggggattgtgggaatcctcgggtgtgctgctgttggggccgcacccaccggccccgcgtccgatacaacaaacgcgaccgcacgcctccccacgcaccccccactcatccgttccgggggctttgccgtccccctcatcgtgggggggctgtgtctcatgattctggggatggcgtgtctactcgaggtcctgcgtcgcctgggtcgcgagttggcgaggtgctgcccccacgcgggccaatttgccccatgatttttcgcctttctggccttgcccccaccccatcgccccgattgtgtgtcgggtgcccggggtacagcagctatggagcggtcggtaatataactttggttgtcgccacacgccccgtgccgggcatgggttgtgcgggaaggacgaaataatccggcgatccccaagcgtaccaactgggggggggggggggaaaagaaactaaaaacacatcaagcccacaacccatcccacaatgggggttatggcggacccaccgcaccaccatactccgattcgaccacatatgcaaccaaatcacccccagaggggaggttccatttttacgaggaggaggagtataatagagtctttgtgtttaaaacccggggtcggtgtggtgttcggtcataagctgcattgcgaacgactagtcgccgtttttcgtgtgcatcgcgtatcacggcatggggcgtttgacctccggcgtcgggacggcggccctgctagttgtcgcggtgggactccgcgtcgtctgcgccaaatacgccttagcagacccctcgcttaagatggccgatcccaatcgatttcgcgggaagaaccttccggttttggaccagctgaccgacccccccggggtgaagcgtgtttaccacattcagccgagcctggaggacccgttccagccccccagcatcccgatcactgtgtactacgcagtgctggaacgtgcctgccgcagcgtgctcctacatgccccatcggaggccccccagatcgtgcgcggggcttcggacgaggcccgaaagcacacgtacaacctgaccatcgcctggtatcgcatgggagacaattgcgctatccccatcacggttatggaatacaccgagtgcccctacaacaagtcgttgggggtctgccccatccgaacgcagccccgctggagctactatgacagctttagcgccgtcagcgaggataacctgggattcctgatgcacgcccccgccttcgagaccgcgggtacgtacctgcggctagtgaagataaacgactggacggagatcacacaatttatcctggagcaccgggcccgcgcctcctgcaagtacgctctccccctgcgcatccccccggcagcgtgcctcacctcgaaggcctaccaacagggcgtgacggtcgacagcatcgggatgctaccccgctttatccccgaaaaccagcgcaccgtcgccctatacagcttaaaaatcgccgggtggcacggccccaagcccccgtacaccagcaccctgctgccgccggagctgtccgacaccaccaacgccacgcaacccgaactcgttccggaagaccccgaggactcggccctcttagaggatcccgccgggacggtgtcttcgcagatccccccaaactggcacatcccgtcgatccaggacgtcgcgccgcaccacgcccccgccgcccccagcaacccgggcctgatcatcggcgcgctggccggcagtaccctggcggtgctggtcatcggcggtattgcgttttgggtacgccgccgcgctcagatggcccccaagcgcctacgtctcccccacatccgggatgacgacgcgcccccctcgcaccagccattgttttactagaggagtttccccgctcccgtgtacctctgggcccgtgtgggagggtggctggggtatttgggtgggacttggactccgcataaagggagtctcgaaggagggaaactaggacagttcataggccgggagcgtggggcgcgcaccgctgtcccgacgattagccaccgcgcccacagccacctcgacccgtccgatcccggtatgcccggccgctcgctgcagggcctggcgatcctgggcctgtgggtctgcgccaccggcctggtcgtccgcggccccacggtcagtctggtctcagactcactcgtggatgccggggccgtggggccccagggcttcgtggaagaggacctgcgtgttttcggggagcttcattttgtgggggcccaggtcccccacacaaactactacgacggcatcatcgagctgtttcactaccccctggggaaccactgcccccgcgttgtacacgtggtcacactgaccgcatgcccccgccgccccgccgtggcgttcaccttgtgtcgctcgacgcaccacgcccacagccccgcctatccgaccctggagctgggtctggcgcggcagccgcttctgcgggttcgaacggcaacgcgcgactatgccggtctgtatgtcctgcgcgtatgggtcggcagcgcgacgaacgccagccggtttgttttgggggtggcgctctctgccaacgggacgtttgtgtataacggctcggactacggctcctgcgatccggcgcagcttcccttttcggccccgcgcctgggaccctcgagcgtatacacccccggagcctcccgacccacccctccacggacaacgacacccccgtcctccccccgagacccgacccccgcccccggggacacagggacgcccgcgcccgcgagcggcgagatagccccgcccaattccacgcgatcggccagcgaatcgagacacaggctaaccgtagcccaggtaatccagatcgccataccggcgtccatcatcgcctttgtgtttctgggcagctgtatctgcttcatccatagatgccagcgccgatacaggcgcccccgcggccagatttacaaccccgggggcgtttcctgcgcggtcaacgaggcggccatggcccgcctcggagccgagctgcgatcccacccaaacaccccccccaaaccccgacgccgttcgtcgtcgtccacgaccatgccttccctaacgtcgatagctgaggaatcggagccaggtccagtcgtgctgctgtccgtcagtcctcggccccgcagtggcccgacggccccccaagaggtctaggtccaagcgggccgttcggcaggcccgccccaccgcccccatcgtggttatttccccccccccccaataaaccgatgttatttgcctatatgcgtgtgttggatccctttgtgatcgttcgtcattccccggatggcatgggaggcgggtaatggatgggcggggcccgggggggaggaaaaagaataaagggggtagtgtcggagaggcccgccgcgcatttaaggagtcgccgccccgactctgtgtcttcgggtgacttggtgcgccgccgtcagctagtctccgatctgccccgaccgacggctcctgccacccgaacatggctcgcggggccgggttggtgttttttgttggagtttgggtcgtatcgtgcctggcggcagcacccagaacgtcctggaaacgggtaacctcgggcgaggacgtggtgttgcttccggcgcccgcggaacgcacccgggcccacaaactactgtgggccgcggaacccctggatgcctgcggtcccctgcgcccgtcgtgggtggcgctgtggcccccccgacgggtgctcgagacggtcgtggatgcggcgtgcatgcgcgccccggaaccgctcgccatagcatacagtcccccgttccccgcgggcgacgagggactgtattcggagttggcgtggcgcgatcgcgtagccgtggtcaacgagagtctggtcatctacggggccctggagacggacagcggtctgtacaccctgtccgtggtcggcctaagcgacgaggcgcgccaagtggcgtcggtggttctggtcgtggagcccgcccctgtgccgaccccgacccccgacgactacgacgaagaagacgacgcgggcgtgagcgaacgcacgccggtcagcgttccccccccaacccccccccgtcgtccccccgtcgcccccccgacgcaccctcgtgttatccccgaggtgtcccacgtgcgcggggtaacggtccatatggagaccccggaggccattctgtttgcccccggggagacgtttgggacgaacgtctccatccacgccattgcccacgacgacggtccgtacgccatggacgtcgtctggatgcggtttgacgtgccgtcctcgtgcgccgagatgcggatctacgaagcttgtctgtatcacccgcagcttccagagtgtctatctccggccgacgcgccgtgcgccgtaagttcctgggcgtaccgcctggcggtccgcagctacgccggctgttccaggactacgcccccgccgcgatgttttgccgaggctcgcatggaaccggtcccggggttggcgtggctggcctccaccgtcaatctggaattccagcacgcctccccccagcacgccggcctctacctgtgcgtggtgtacgtggacgatcatatccacgcctggggccacatgaccatcagcaccgcggcgcagtaccggaacgcggtggtggaacagcacctcccccagcgccagcccgagcccgtcgagcccacccgcccgcacgtgagagccccccatcccgcgccctccgcgcgcggcccgctgcgcctcggggcggtgctgggggcggccctgttgctggccgccctcgggctgtccgcgtgggcgtgcatgacctgctggcgcaggcgctcctggcgggcggttaaaagccgggcctcggcgacgggccccacttacattcgcgtggcggacagcgagctgtacgcggactggagttcggacagcgagggggagcgcgacgggtccctgtggcaggaccctccggagagacccgactctccctccacaaatggatccggctttgagatcttatcaccaacggctccgtctgtatacccccatagcgaggggcgtaaatctcgccgcccgctcaccacctttggttcgggaagcccgggccgtcgtcactcccaggcctcctatccgtccgtcctctggtaaggcgtcttccgacgacgcggacgtcggcgatgaactgattgccatcgcggacgcacgcggggacccgccagagaccctgccccccggcgcgggcggcgccgcgcccgcgtgccgcagaccacctcgcggcggctcccccgcggcctttcccgtggccctccacgccgtggacgccccctcccaattcgtcacctggctcgccgtgcgctggctgcggggggcggtgggtctcggggccgtcctgtgcgggattgcgttttacgtgacgtcaatcgcccgaggcgcataaaggtccggcggccagccccgccgcagctcataaaaatcgtgagtcacggcaaccgcaccttcgcctccggccctccgccagcgcccttccgcgtccgcgatgacctcccggcccgccgaccaagactcggtgcgttccagcgcgtcggtgccgctttaccccgcggcctcgcccgtcccggcagaagcctactactcggaaagcgaagacgaggccgccaacgacttcctcgtgcgcatgggccgccagcagtcggtcctaaggcgccgacggcggcgcacgcggtgcgtcgggctggttatcgcctgtctcgtcgtggccctcctatctggagggttcggggcacttttggtgtggctgctccgctaaatgacgcctcgatgtatggcgccttcttcgcccccacccctcgccgcgacccacgtccgtatgttaattgcaataaagtggttgattgtcattacggtctactaggttgtcttttttttttgggggggggggaggaaatgcagaaaagggtaagaaattctcggaatttcacccccgggggggggcaagtgcagtaacccagttcctcagtgtttgggaaatctattgaactctcccggctcctccgtgttagggaagtctcttggggaaatctattgacctctcgccccccccccccaggaggggggcagtgcagtaccccagttcctccgtgctggggaaatctctctgccgggtacgggctccagacgaaggacccatacatttccccatccgcaccccacatctggcgttctagagtcacgacgcatttgcccccgtccccgcagcaacacacaaagcgatttcaattttcacgattttattattaattacaccaaccaccctgtccccgggacgtggtcaggaccgggggtccgcacccaaacgcacgaaacaaatgctggcagtgtgccgaatataaccccgcgtaggaacacgtcgacgcgtgcgccaaacagcaccagaaggcgcatgccatcagcaggtcgtgcatatggcgatgtgtttggacgcagggcgcagccgcggcgataaaattcatggcggccgtccgccagggccacagcggcgaggactccctgttggcccgaagccattgggtatgaaccagctgcgcctcctgtccgaccctggctcccgccagcgggggcggtgggtcgtgggtgttgagagcacacaggcgggacacctcgatcaccgtccgaaaaaaggcccggtggtccgcgggcagcatctgcaggtgcgccagggcctgggcgttgagagggtacaactcggagccgggggactccgggggccggtccgcgcggtgccgcgagttggcacgctttggggcccgggtgtcggacgcgggcgcgttatggatcccgacgcggggcagaacgtacgtgcgttggcgcggcgatgaggggtccgggctgccgaggggggcgtaggggaccgggctaggcaagcccgcgggttgcgcggggttcccgtgggggtctaggctccctgggcacccgtgggggtcgtgggggtcgcgggtccctgggtatgcgcgggaccctgggttctctgggagatcgtggaactcgcggttccctgggctctcggggaacccggggctccctggggacacgtggtgccctgggaattcttgatggtcggacggcttcagatggcttcgggatcgagagggccgcacagactcgtagtagacccgaatctccacgtttccccgccgccggatcatggtcgccgccccggtgcgggggcccgtcggtcggaagcgagtgcccttcaagcgtgtccgctcctctgggctgcatgccgtcggatggggtgccttttaaggaaaggtctcggctgcccgccccaaccggggtttgggggtgggccggggaaaccccggatgccatgggggggtcacaccctaagcgccggcgcgctggttgggtgggggtagaggggagtccccggtcgacgagatcgtataagctgggtaccgagctcgaattcatcgatgatatcagatcgatccccatggtgtcccgtccacgaaggcggcgcccggcctgcgagaaagcgcggatgttgggatcggggccccgtccccccgttccccggcccgtccccccgtccccccggcccgtccccccggcccgtccccccggcccggccccccgggtcaccgtacctgcgataaggctgcagtgggtggatgggtcctcgcggtacgtacagggtgggggggggggggggagggaaaggcagaacgaaaaggaaccgatgcgcccgcgtctctgtatccgatccgatccgggtgcgtcggtgccccgctcgccgccggcgtctctgtctcgctgtggcccccttcgcgatgccgccgctgccgtcccggtctccgccgcgcagccggtgtgcccctggtgcggcggcgaccgggacgccggccctttatgtgcgcgaggaacggcccgccccccgtccgggcccgcctcggggcggagcccgcgggatgacgcgggccccgggcagggcgccagtgctcgcactttgccctaataatatatatactattaggacgaagtgcgaacgcttcgcgttctcacttcttttaccctgcggccccgccccctttggggcggagcccgcgggatgacgcgggccccgggcagggcgccagcgctcgcactttgccctaataatatatatactattaggacgaagtgcgaacgcttcgcgttctcacttcttttaccctgcggccccgccccctttggggcggagccgcccgcggaccaacggggcgacctcgccggcccctttggggccggcgggggccaacgggagcgcggggccggcatctcattaccacgaacccggaagggcaggggagcgagcccgcccgcgacgagggtctcattagcatcgcgggcggaagcggaagccgcccgcgccgggcgctaatgagatgccgcgcgggcggagccggcggcggcgcgaccaacgggccgccgccacggacgcggacgcgcgggcgtcggggcggggccgcgcataatgcggttccacctgggggcggaaccccggcgagccggggcgcggcggcgtcgatcgctcctcctccgcgtcctcctcctttccccccgccccgcgcgccccgaggactatatcagccaggcgacggggcgatcgtccacacggagcgcggctaccgacgcggccgccaggatctacccgatcggcgcggagaggcgaaaagacacaggcacacgcacgcaccgcacgggggggagagagactgccaaccacccccccccactgccgcccctgaagaagaagaagaagacccccccccgcacaccccggtcggaggcgatgtcggcggagcagcggaagaagaagaagacgacgacgacgacgcagggccgcggggccgaggtcgcgatggcggacgaggacgggggacgtctccgggccgcggcggagacgaccggcggccccggatctccggatccagccgacggaccgccgcccaccccgaacccggaccgtcgccccgccgcgcggcccgggttcgggtggcacggtgggccggaggagaacgaagacgaggccgacgacgccgccgccgatgccgatgccgacgaggcggccccggcgtccggggaggccgtcgacgagcctgccgcggacggcgtcgtctcgccgcggcagctggccctgctggcctcgatggtggacgaggccgttcgcacgatcccgtcgccccccccggagcgcgacggcgcggaagaagaagcggcccgctcgccttctccgccgcggaccccctccatgcgcgccgattatggcgaggagaacgacgacgacgacgacgacgacgatgacgacgaccgcgacgcgggccgctgggtccgcggaccggagacgacgtccgcggtccgcggggcgtacccggaccccatggccagcctgtcgccgcgacccccggcgccccgccgacaccaccaccaccaccaccaccgccgccggcgcgccccccgccggcgctcggccgcctctgactcatcaaaatccggatcctcgtcgtcggcgtcctccgcctcctcctccgcctcctcctcctcgtctgcatccgcctcctcgtctgacgacgacgacgacgacgacgccgcccgcgcccccgccagcgccgcagaccacgccgcgggcgggaccctcggcgcggacgacgaggaggcgggggtgcccgcgagggccccgggggcggcgccccggccgagcccgcccagggccgagcccgccccggcccggacccccgcggcgaccgcgggccgcctggagcgccgccgggcccgcgcggcggtggccggccgcgacgccacgggccgcttcacggccgggcggccccggcgggtcgagctggacgccgacgcggcctccggcgccttctacgcgcgctaccgcgacgggtacgtcagcggggagccgtggcccggggccggccccccgcccccggggcgcgtgctgtacggcgggctgggcgacagccgccccggcctctggggggcgcccgaggcggaggaggcgcgggcccggttcgaggcctcgggcgccccggcgcccgtgtgggcgcccgagctgggcgacgcggcgcagcagtacgccctgatcacgcggctgctgtacacgccggacgcggaggcgatggggtggctccagaacccgcgcgtggcgcccggggacgtggcgctggaccaggcctgcttccggatctcgggcgcggcgcgcaacagcagctccttcatctccggcagcgtggcgcgggccgtgccccacctggggtacgccatggcggcgggccgcttcggctggggcctggcgcacgtggcggccgccgtggccatgagccgccgctacgaccgcgcgcagaagggcttcctgctgaccagcctgcgccgcgcctacgcgcccctgctggcgcgcgagaacgcggcgctgaccggggcgcgaacccccgacgacggcggcgacgccaaccgccacgacggcgacgacgcccgcgggaagcccgccgccgccgccgccccgttgccgtcggcggcggcgtcgccggccgacgagcgcgcggtgcccgccggctacggcgccgcgggggtgctcgccgccctggggcgcctgagcgccgcgcccgcctccgcgccggccggggccgacgacgacgacgacgacgacggcgccggcggtggtggcggcggccggcgcgcggaggcgggccgcgtggccgtggagtgcctggccgcctgccgcgggatcctggaggcgctggcggagggcttcgacggcgacctggcggccgtgccggggctggccggagcccggcccgccgcgcccccgcgcccggggcccgcgggcgcggccgccccgccgcacgccgacgcgccccgcctgcgcgcctggctgcgcgagctgcggttcgtgcgcgacgcgctggtgctgatgcgcctgcgcggggacctgcgcgtggccggcggcagcgaggccgccgtggccgccgtgcgcgccgtgagcctggtcgccggggccctgggcccggcgctgccgcggagcccgcgcctgctgagctccgccgccgccgccgccgcggacctgctcttccagaaccagagcctgcgccccctgctggccgacaccgtcgccgcggccgactcgctcgccgcgcccgcctccgcgccgcgggaggcgcgcaagcgcaagagccccgccccggccagggcgccgccgggcggcgccccgcgccccccgaagaagagccgcgcggacgccccccgccccgcggccgcccctcccgcgggggccgcgccccccgccccgccgacgccgccgccgcggccgccgcgccccgcggcgctgacccgccggcccgccgagggccccgacccgcagggcggctggcgccgccagccgccggggcccagccacacgccggcgccctcggccgccgccctggaggcctactgcgccccgcgggccgtggccgagctcacggaccacccgctcttccccgcgccgtggcgcccggccctcatgttcgacccgcgcgcgctggcctcgctggccgcgcgctgcgccgccccgccccccggcggcgcgcccgccgccttcggcccgctgcgcgcctcgggcccgctgcgccgcgcggcggcctggatgcgccaggtgcccgacccggaggacgtgcgcgtggtgatcctctactcgccgctgccgggcgaggacctggccgcgggccgcgccgggggcgggccccccccggagtggtccgccgagcgcggcgggctgtcctgcctgctggcggccctgggcaaccggctctgcgggcccgccacggccgcctgggcgggcaactggaccggcgcccccgacgtctcggcgctgggcgcgcagggcgtgctgctgctgtccacgcgggacctggccttcgccggcgccgtggagttcctggggctgctggccggcgcctgcgaccgccgcctcatcgtcgtcaacgccgtgcgcgccgcggactggcccgccgacgggcccgtggtctcgcggcagcacgcctacctggcctgcgaggtgctgcccgccgtgcagtgcgccgtgcgctggccggcggcgcgggacctgcgccgcaccgtgctggcctccggccgcgtgttcgggccgggggtcttcgcgcgcgtggaggccgcgcacgcgcgcctgtaccccgacgcgccgccgctgcgcctctgccgcggggccaacgtgcggtaccgcgtgcgcacgcgcttcggccccgacacgctggtgcccatgtccccgcgcgagtaccgccgcgccgtgctcccggcgctggacggccgggccgccgcctcgggcgcgggcgacgccatggcgcccggcgcgccggacttctgcgaggacgaggcgcactcgcaccgcgcctgcgcgcgctggggcctgggcgcgccgctgcggcccgtctacgtggcgctggggcgcgacgccgtgcgcggcggcccggcggagctgcgcgggccgcggcgggagttctgcgcgcgggcgctgctcgagcccgacggcgacgcgcccccgctggtgctgcgcgacgacgcggacgcgggcccgcccccgcagatacgctgggcgtcggccgcgggccgcgcggggacggtgctggccgcggcgggcggcggcgtggaggtggtggggaccgccgcggggctggccacgccgccgaggcgcgagcccgtggacatggacgcggagctggaggacgacgacgacggactgtttggggagtgacgggggggaaacttccgggagcgggggaggggggagatggggagagggggaaggaatcgggcgtctgtgcgcctttaagacagacgcggcgatggccgcgcgcgtgtgtgagaaataaagaacgagacagacgaaaacgtaccgccttgtgtggtttattcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggtgggcggcacgtctcccgcgcccgcggggggtctggggctctgacctgagtgcaggttacgaaggtcaggtggcccgagcccccccgcaggagcgggagggaaggcacggggcgcgggagggaggggctgctgcgagctcggggccgcgggcgcggggggaggggcgggggaagcccccggggcggggcgcgggggaggcggccgcgggggaggcggccgcgggaccgcagccccgtggcgcgcgggggggaggggctgccgcgagctcggcgggatggaggggagggagggggtggcggggaaccgtgtgcgggcgggcgggtgcttggtgcaactgtctggtctgcgagggcgagcggtggtgcgactggcgtcttcgggggggcggggagcttgggagtgtgtggtggtctgcggcacagcctgctagtccccgtcttgccgcgcgggggcgggcgcgggaaaaaagccgcgcgggggcgcccgcgggaaggcagccccgcggcgcgcggggggaggggcggcgcccgcgggggagcggccggctccgggggagggacggggaagggggcgcgcggggctgccctgccgcccgcccgccgccgccgcccgccttcgcgcccccccccaaaaaacaccccccccgggggttgactccccgggggaaaagaggcggggcggg

SEQ ID NO: 23 - DNA, 154715 bp, synthetic construct
  source 1..154715: mol_type = other DNA
agtccccgtcttgccgcgcgggggcgggcgcgggaaaaaagccgcgcgggggcgcccgcgggaaggcagccccgcggcgcgcggggggaggggcggcgcccgcgggggagcggccggctccgggggagggacggggaagggggcgcgcggggctgccctgccgcccgcccgccgccgccgcccgccttcgcgcccccccccaaaaaacaccccccccgggggttgactccccgggggaaaagaggcggggcgggagtccccgtcctgccgccgccccttaagagggcccgcaacacggcccgggctgcgcacgccagccgggacgggtgagttcgctaggcaagcacggactggcggttacacggataacctggttctttccgcctcagaagccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagcatttaggtgacactatagaatagggccctctagctcgagtcactcctggactggctcccagcagtcaaaggggatgacaagcagaaagtccttcaggttctctttgaaactttcaaaggtgataatctgggttgcacaggaagtttccggggttggagggcagtgctgcttgtagtggctggccatcatggtcaaggggcccttgagcttggtgaggctgccccgcaggccctgcttgtacagctccaggcgggtctgtaggcaggtcggctcctggaggtcaaacatttctgagatgacttctactgtttcattcatctcagcagcagtgtctctactcaggttcaggagacgccgggcctcctggatggcattcacatgctcccagggctgcgtgctggggctgggcgagcgggcgggtgcagagatgctgcaggccacagtgcccaagagcagcaggctctgcagccacatggatccagcttgggtctccctatagtgagtcgtattaatttcgataagccagtaagcagtgggttctctagttagccagagagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacgcgtatatctggcccgtacatcgatcatcgatgaattcgagctcggtacccggggatcctctagaccggcttcccggtatggtaattagaaacttttaataggcggtcccggccgccatccccgcgcatggtaattagcaacttttaatgggccggcgttcccgctcgcggtaattagcagcttttaacgggccgccattcccgcttatggtaattaaaaacgttcggacggcccctcgctccccgcgtaattactccctcggggttccgggttatgctgattactttcttggcagaacacgcagagcctcgcgcgccgccgggtgggtgggctgatcggcccctattggtcccctgggcttcctagtatgctaatgaatttctccccgggggcgggcaccactcagggccgcgccggcggggcgccggggggactcccatctgcgtcggcggggggcggcgcatgctaatggggttcttggagtacacccggttggtccccggggacggggccgccccgagagggggggattccctccctccgcccccgccggggcgcgcggctattgggggaatcgtaaatgccgcccctttgggggagtggataggcgccgggtataaggcagccccgtgtgacggtcgggccgcattcgcaccccggcactgcgagcgacggagcggcggcccggcgggaggaggagacccggagagacagagactaaaacccggcaagagagagaccgcgggccgccgtctcgagtctaccctaccccggctcatggaaccccggcccggcacgagctcccgggcggaccccggccccgagcggccgccgcggcagacccccggcacggtgagagggcgacccccgggtctcaggcccccccttttccccggaccacccggctgcgggttgggggtggtcgcgggcggtgggctcgggggcggggacgcttgacggggccgacccccggcccgcttaagcggtcgggggacccccgtgggccgtgcgccgccccccgaccctctgggggggcgagggaggcagggaggagcccgagagcgggggacagggggggagacgaggggtcggaatccaaaggacgcagaccacctttggttacggacccctttctcccccccttccgaacaaaaagcagcgggcggggggccggggtgagggagggacacgggggacacggcgcgggggtcccgcctcacgccccgcgccctctaaatcccccccgttgctttgtcaagcagcccgccgccccgcacgcctgggggatgctcaacgacatgcagtggctcgccagcagcgactcggaggaggagaccgaggtgggaatctctgacgacgaccttcaccgcgactccacctccgaggcgggcagcacggacacggagatgttcgaggcgggcctgatggacgcggccacgcccccggcccggcccccggccgagcgccagggcagccccacgcccgccgacgcgcagggatcctgcgggggtgggcccgtgggtgaggaggaagcggaagcgggaggggggggcgacgtgtgcgccgtgtgcacggacgagatcgccccgcccctgcgctgccagagttttccctgcctgcaccccttctgcatcccgtgcatgaagacctggattccgttgcgcaacacgtgtcccctgtgcaacaccccggtggcgtacctgatagtgggcgtgaccgccagcgggtcgttcagcaccatcccgatagtgaacgacccccggacccgcgtggaggccgaggcggccgtgcgggccggcacggccgtggactttatctggacgggcaaccagcggacggccccgcgctccctgtcgctggggggacacacggtccgcgccctgtcgcccacccccccgtggcccggcacggacgacgaggacgatgacctggccgacggtgagggcgggcgggggtcgggcgggggtcgggcgggggtcgggcgggggtcgggcgggggtcgggcgggggtcgggcgggggtcgggcgggggtcgggcgggggtcgggcgggggtcgggcgggggtcgggcgggggtcgggcactaaccgggggctcccgtctctgtctccctctgcagtggactacgtcccgcccgccccccgaagagcgccccggcgcgggggcggcggtgcgggggcgacccgcggaacctcccagcccgccgcgacccgaccggcgccccctggcgccccgcggagcagcagcagcggcggcgccccgttgcgggcgggggtgggatctgggtctgggggcggccctgccgtcgcggccgtcgtgccgagagtggcctctcttccccctgcggccggcggggggcgcgcgcaggcgcggcgggtgggcgaagacgccgcggcggcggagggcaggacgccccccgcgggacagccccgcgcggcccaggagccccccatagtcatcagcgactctcccccgccgtctccgcgccgccccgcgggccccgggccgctctcctttttctcctcctcctccgcgcaggtgtcctcgggccccggggggggaggtctgccacagtcgtcggggcgcgcggcgcgcccccgcgcggccgtcgccccgcgcgtccggagtccgccccgcgccgccgccgcccccgtggtgtctgcgagcgcggacgcggccgggcccgcgccgcccgccgtgccggtggacgcgcaccgcgcgccccggtcgcgcatgacccaggctcagaccgacacccaagcacagagtctgggccgggcaggcgcgaccgacgcgcgcgggtcgggagggccgggcgcggagggaggacccggggtcccccgcggcaccaacacccccggtgccgccccccacgccgcggagggggcggcggcccgcccccggaagaggcgcgggtcggactcgggccctgcggcctcgtcctccgcctcttcctccgccgccccgcgctcgcccctcgccccccagggggtgggggccaagagggcggcgccgcgccgggccccggactcggactcgggcgaccgcggccacgggccgctcgccccggcgtccgcgggcgccgcgcccccgtcggcgtctccgtcgtcccaggccgcggtcgccgccgccgcctcctcttcctcctccgccgcctcctcttcctcctccgccgcctcctcttcctcctccgccgcctcctcttcctcctccgccgcctcttcctcctccgccgcctcctcttcctcctcctcctcctccgcctcttcctctgcgggcggggctggtgggagcgtcgcgtccgcgtccggcgctggggagagacgagaaacctccctcggcccccgcgctgctgcgccgcgggggccgaggaagtgtgccaggaagacgcgccacgcggagggcggccccgagcccggggcccgcgacccggcgcccggcctcacgcgctacctgcccatcgcgggggtctcgagcgtcgtggccctggcgccttacgtgaacaagacggtcacgggggactgcctgcccgtcctggacatggagacgggccacataggggcctacgtggtcctcgtggaccagacggggaacgtggcggacctgctgcgggccgcggcccccgcgtggagccgccgcaccctgctccccgagcacgcgcgcaactgcgtgaggccccccgactacccgacgccccccgcgtcggagtggaacagcctctggatgaccccggtgggcaacatgctctttgaccagggcaccctggtgggcgcgctggacttccacggcctccggtcgcgccacccgtggtctcgggagcagggcgcgcccgcgccggccggcgacgcccccgcgggccacggggagtagggggagctaacactcggcttgctgcccaaagggaagccgccccccaccggaccaccggccgaggcgcctcgggggcagggggaggtgggggggaaagacggggaggagacaggaagtgggggtgggagtggggggggacggacacggccccgaacagcaacacacaccagcattttgttatggactttctggccttgttgaaaacttgaggaaaaaaaactttatatttataaaaattttacaataaagttttgtgatgcttttgacacactttgttgttggcctttgatgcagctcccccgcgcaggggggccggggatggggggggggaaagggaggaggaggagggggggcgggcacgagaagccgcccccacccccgaggcctgttggtctttatgatagaacagagccggggcccggcctgcgttctggctccctgtcttggtgggtgggcgggctggctggcgggtaaaaaaagagtgtgtccgtgttgacagggaggggggcccgatcgtgcagagcacgcacgtctggccggccagaccctgggggtggtgggcaggagtgggagggcgcctggctcggggagggaggagggggggggtcagccgcaccaccggcgcgaagccaggggccagggaactttgatagagagggggggaaagtggggcgggggcgagggcggttgaatcacaacgcatgcacgccctctgcccccggggacgggtgggaggaaggaggagggagaagagaagacccgaggcatgcacccgcacttacgcccgtgcccacccccgccccggcgcccaccccgcccgcacacctgcccgccacgcccgcccctcctcaccctggctgggagaaaggaggaggagcaggaagaggagacccgaggcatgcaaccgcactcaccccaccccgcccgcacacctgcccgccacgcccgcccctccttaccctggctgcggggagactcccatcggggcgagggggctcgcgcgttcgcaacaccacaccacaccacacggcccaccacaacacggcccaccacgacacaacacgacacgacgcgttttgcggggcatgcaagtcgacacaccgcgcgcgtgcctacctttccctagcggccccggcccccggcccgtttccttccgccaccactaccaccacccccccgcccgcgcccacgcggtagaggaaggggacgggcgccacacccacggctgtggctgggcacgcgcctttggggttgttgggggggggtgaccggcgcgtgggggcggtgggcgtatgggcccgacccgcgcctgccccccctgggaacgacgcccccggacgacaccacgggggggggaaacgggggtgggtggaagggaagaggaaggagaaagggggggtggatccgaacacgccggatccgcgaaaataataacaaaacaaacaaaaacagaaacaaaaacaaaaacacctagaaaaaaaggatacgggttggctcgcgggcggtgcggctgacctgcctgccctttctgggacccccgcctcgtgtttcttgaaagggggaggaagaacagttctcccccaacccctgctctcttctctcttccgcccgccccccccccctctcccgccgcctcagcagaagctcacctgtacgaccctaaacctacctgcgagaacgcgcggcgttcgaggggcgcgctctctcacacgagacacacgcaggcgccccccccccccggagcctgggtcccccggcggacggctcacgcggcgcggcgtctcggtgggacgcgggcagagggcggcggcggcgggggggggggggaaatgtgaggagagcgagacagagagagagaaggaagagggaaggggcgcggcgggacgggggaagacgaggagaagggaaggggcgagggtcgggcccgggagcggggcggccgggagggagaagaaacggaacgcggaaacgccgccggcgcggcccggggccccggggcccccgcgctccgccgggggcccgggccggaccgccgggcgggggacgccttccgcccggcgccgggcggctacccgggacccccggccgggaatcgaaaaaagcctccgggggcccctttcgcgcctttcgcgaacgcgcggcgccggagggggcggccgccgaggtgcgggggcccctccggccggggcgcacctcggcggccaagccccggcccgcccgggggtccccgaggcagaggcggaccctcggaggcgcggaagaagacgggaggcgggggaaaaaagggggaagagagggggaggtagggaggggagaggagaagggcgcgccggtgcgcggagcagccttccttctccggagtccctctcgatcggcggcgggcccctgcgttcgttgctgccgcgcccccggttttataaagacagggatgacgcagcagaaatgcccacagcaacacgcgggcggggctcgggctctccggcggcttaatggatctccgggcacggcgcccgcaaccgcagagcactcagctggcgcgcccccccccaacgtgggagtgtttaatggaagggcgtggggccggccgccggatgcccgcgggggcctaatgcggcgggaggcgtgggccgctggcgccgcggcccgtctgctggcccgcggcccgtctgctggcccgcggccacgtaaacaatgacacaggggttctctccgccgcggccggcgcggggcgttgccggcccggcccggccccggagcccgcggcgctgctcggctgcggccgcgggctccgggggctccgcactctgcccggctcgccccgtcccccctcttgctgcttttccgcgcgcctctctttcccgttgctttccctctccccccccccccctctctctctctctctctctctctccgccatcctcccgcccggccgcccactccccgctcggcctctccggctgcggtgcttgggtctccttcgtcgggcggcggggggggggcgtcgggactcgcggagggccggagaatggaaggcgaggggatgcaggaggaggatcgggactccccatcttctgcccttccatcctccgtttttccgctttccaccgccgccgccaccacccccccttccttcgcccgcccgcctcgccccggacccctcccccccgtgttccccccatcgttcaccaccacgccccccaccgcgccttggctgtttggggggtggcggcggtggtcggcgtgctgccggaggctgcgggcgcggggtaggtgggtgggcgggtggtgggggggggcccggctgcgtctcgccgcgatcccgccggtggggcgcggcggcggtcggggtggggggagagtgtcgtgggtgtgttttcgtgtcccccaccaccactcccaccccgaccgccgccgcgcccgcgtttctgccgcccgcgcgctcctgtgtggaccccggggtgggcggcggggggggggtgccgtgggtgtggcggcggggcgcgggccggggccggggctcgctggtccgccgaagtaaagaaaagatcgccaccgtgtgttcgtctgtgtgttctgcgcggcgccggggcccccctgccgggcggggcggtggggcggggccggggtcgcggcggggaaggaaggaaagaccccggaagcgccgggagggggcgccggcgcgacgcgggcggccgggcgggggcgcgcggcggccgggcgggggcgcgcggcggccgggcgggggcgcgcggcggccgggcgggggcgcgcggcggccgggcgggggcgcgcggcggccgggcgggggcgcgcggcggccgggcgggggcgcgctttccccgcgtcgcccctcgggttcccaagacctatcacgtgtgcgcaggggaggggaggacgcgggggaggggaggacgcgggggaggggaggacgcgggggatatataaagcggtagaaagcgcgggaatgggcatattggacccgcgtgattcggttgctcgcggttgtcttgtttggacgttttttatgcgggaacaagggggcttaccggttacactgtccgctcgctatggggttcgtctgtctgtttgggcttgtcgttatgggagcctggggggcgtggggtgggtcacaggcaaccgaatatgttcttcgtagtgttattgccaaagaggtgggggacatactaagagtgccttgcatgcggacccccgcggacgatgtttcttggcgctacgaggccccgtccgttattgactatgcccgcatagacggaatatttcttcgctatcactgcccggggttggacacgtttttgtgggataggcacgcccagagggcgtatctggttaacccctttctctttgcggcgggatttttggaggacttgagtcactctgtgtttccggccgacacccaggaaacaacgacgcgccgggccctttataaagagatacgcgatgcgttgggcagtcgaaaacaggccgtcagccacgcacccgtcagggccgggtgtgtaaactttgactactcacgcactcgccgctgcgtcgggcgacgcgatttacggcctgccaacaccacgtcaacgtgggaaccgcctgtgtcgtcggacgatgaagcgagctcgcagtcgaagcccctcgccacccagccgcccgtcctcgccctttcgaacgcccccccacggcgggtctccccgacgcgaggtcggcgccggcatactcgcctccgacgcaactagccacgtctgcatcgcaagccaccctgggtcgggagcaggacagccgacccgtctagcggccgggtcggctgtccagcgtcgtcgccctagaggctgtccgccgggcgtgatgttttccgcatctacgacccccgaacagcccctggggctgtcgggcgatgcgacgccgcccctgccgacttccgtgcccctggactgggccgcgtttcggcgcgcgtttctgatcgacgacgcctggcggcccctgttggagccggagctcgcgaaccccctaaccgcgcgcctcctcgcggagtatgaccgtcggtgccagaccgaagaggtgctgccgccgcgggaggatgtgttctcctggacgcggtattgtacccccgacgacgtgcgcgtggttatcatcgggcaggacccgtaccaccatcccggccaggcgcacggcctggcgtttagcgtgcgtgcggatgtgccggtgcctccgagtctacggaacgtgctggcggcggttaaaaattgttaccccgacgcgcgcatgagcggccgcggctgcctggaaaagtgggctcgcgacggcgtgctgttgttgaacacgaccctgaccgtcaagcgcggggcggcggcgtcccactccaagcttggatgggaccgttttgtgggcggggtggtccgacggctggccgcgcgccgcccgggcctggtctttatgctctggggcgcccatgcccagaacgcgatcaggcccgaccctcgccaacactacgtcctcaagttttctcacccgtcgcccctctccaaggtcccgtttgggacgtgccagcatttcctcgccgcgaatcgctacctcgaaacccgggacattatgccgatcgactggtcggtataagatgccgacatccggggtcttgatttacgagggggcaattaataaagactgttgatggttaaatctcgggtctcataccggtccgtgatgtcgggcgtgggggaagagagggtcccctctgcgtttactatccttgcctcgtggggctggacgtttgcaccccagaaccatgatcctggcgcgtcgccgaatacgacgcccatagagtcgattgcggggaccgcaccggacgcgcacgtggggcctctcgacggagagccggaccgggatgcgatctccccgcttacgtcgagcgtggccggcgacccgccgggggcggacggcccctacgtcacctttgatactctgtttatggtatcttcgatcgacgaactggggcgccgccagctcacggatacgatccgtaaggacctgcggctgtcgctggccaagttcagcatcgcgtgtaccaagacctcgtcgttttcggggacggccgcgcgccagcgcaagcgcggagcaccgccgcaacgcacatgcgtaccacgcagcaacaagagcctccagatgttcgttttgtgcaagcgcgccaacgccgcgcaggtgcgcgagcagctgcgggcggttattcggtcgcgcaagccgcgcaagtattacacgcggtcctcggatgggcggctctgcccggccgtccccgtgtttgtacacgagtttgtttcgtccgaacccatgcgcctccatcgagataacgtcatgctgtctacggaaccagactaagcacccccgccgtcccctttcttttccccctacccttccccccgttactgatgtgttgtgacgtttcaataaataacacgtagcttattttgttggatgatggattgattgattttattgaccgttcgttcgcccggcggtgccgtcgccgcgcgcagagggaatatgcaagcgggcggggtggggaggaaagaaggtttcaggttccgggggttgggtctgcgtcgtccagggtggggctgatctgaatttcccgcagaacctcgaccagtaggtctgttgtgtttgctgggaactcgcccgccgttggggatacgggggcggggggtgtggtcgggcggacgtccaggggtgcgttatcgcacccccgcgccgcctcgggggccgtcccgtagatcgttgcggtgatgtagatggtgtccggggtccacaccaccgtcaggatgccggccgtcgcactccggacgctttcgccgtgcgatgagctgacccaggagtcaaaggggtacgcgtacatatgggcgtcccaccagcgctccagcctctgggtactagcgcgtcctataaagcggtatgcgcaaaattcggcacgacagtcgataatcaccagcagcccgatgggggtgtgttgtatcaccacgcctccgcggggcaggcggtcctggcgcgctcgaccccgcgtcagaaccgcgcgcgtccctgactcaaacacgtgcaccacctgtgccgcgtccggcagcgcgctcgttagcgacgccctggggtgatgtaggctgtacgcgatggtcgtctgggggttccccatgtctcgggggggtgggggtgaatgtcacccggcccgggtgcggtgggaacgcgagggaatggagggttaatagacaatgaccacattcggatcgcgtagagcagatagtatgtgctcgctaatgacgtcatcgcgttcgtggcgctcccggagcgggtttagattcatgtgcaggaactcggatgaggtggtgcgggacatggctacgtacgcgctgtttaggcgcaggtttccgggcgtgaagcatatggcgaccttgtccagactgagcccctgggagcgcgtgatggtcatcgcgagtttggagctgatgccgtagtcggcgttgatggccatggccagctccgtggagtcgatcgactcgacaaactcactgatgttggtattgacgacagacatgaagccgtgctggtcccgcaggacgatgtagggcaggggggactcctccaagaactcggccacgccggccgtcgcgtgccgccgccgcagctcctccgcgaacgcgaacacccgggtgtacgtgtaccccatcagcgtgtagttgtccgtctgcagggccacggacatcagccccccgcgcggcgagccggtcagcagctcgcagccccggaaaatgacattgtccacgtaggtgctgaagggggcgctctcaaacacctccccgaagagctcccgtaggataaggtatcgccccagaaaggccctcttcaggagcccaaactgggcgtggacggccgcggtggtctcaggctcttcgagggcgtagtggcagtagaacacgtccagctgctgttcgtccagcccggcgaagataacgtcaaggtcgtcgtcggggaagtcgtccgggcccccgtcccgcgggcccaggtgcttaaaattgaacgcacgctcccccggagagcggtcgctggtgtcggcggccctggttgccgatgcgccggcggcgtcccggcgtagcgacaggagttctgccgtcagctcccctaggcggccgtaggccagggtcctctgggtcgcgtccaggccggggcgctggagaaagttgtaaaagtgaatcagcccgccgaacatgagccgcgacaggaaccggtaggcgaactccaccgaggtctccccctgggtcttcacgaagctgtcgtcgcgcagcacagcctcgaaggtccgaaacgtcccgtcgaacccaaacaccatctttcggaggcgcgcggtcaccgcgacctggctgttgaggacgtacgtgatgtcgttccgggccacgactagctgttgcttgctgtgcacctcacagcgcacgtgccccgcgtcctggtcctgactctgggagtagttggtgatgcgactggcgttggccgtgatccacttttccatggtcagcgtgggttgctgcgtgagccgtcgatactcgtcaaactctttgaccgacacaaacgtgagcacggggagggtaaacacaacaaactccccctcgcgagtcacctttaggtaggcgtggagcttggccatgtacgcgctgacctccttgtgggacgagaacagccgcgtccaccccggaaggttggccgggttggtgatgtaactttccgggacgacaaagcggtccacaaactgcatgtgctcctcggtgatgggaaggccgtactccagcaccttcatgaggttcccgaactcgtgctccacacatcgcttgttgttaatgaaaatggcccagctgtgcgagaggcgcgtgtactcgcgtagggtgcggttgcagatgaggtacgtgagcacgttttcgctctgccggacggagcatcgcagtttttggtgttcgaaggtggactccagcgaggccgtctgggtcggcgaccccacgcacaccagcaccggccgcaggcggcccgcgtactggggggtgtggtacagggcgttaatcatccaccagcaatacaccacggtcgtgagtaggtgccgccccaggagcccggcctcgtcgatgacgataatgttgctgcgggtgaaagccggcagcgccccgtgtgtgaccgaggccaggcgcgtgagggcaccctggcccagccccaaagtctgctctagggcggtgagggcgtggaactcgtttcgcgcgtcttcgcccccgtgcgccgccagggcccgcttggtgatgtcgaggatcacctcccagtagtacgtcaggtctcgccgctgcaggtcttccagcgaggcggggctgctggccagggtgtacgggtgctgccccagctgggcctggacgtgattcccgcgaaacccgaactcgtgaaagatggtgttgatgggtcgactcagaaacgcccccgagagcttaacgtacatgttctgcgccgcgattcgcgtggcgcccgtgaccacgcagtccaggacctcgttgagggtctgcacgcacgtactctttccggatccggcgttgccggtgatgagatacgccgcgaacggaaactcccggagcggcaggccggtcgggacctccaaggccgccacgtcccggaaccactgcaggcgcggcacctgcgtgacgtcgagctgctgctgcgagagctctcggatgcgtgcgatgattggttggaccccgtgcatggacgtaaaatttaaaaacgcctcgtccctgaaccgcacggcgggtctggccccgggctgctgtgggggcggacctggtgcccggacgtcccgcgagccctccccgccggacgccgccatggccgcacagcgcgcgcgggcgccggcgatgcggacgcggggcggcgacgcggcgctatgcgcccccgaggacggctgggtgaaggttcaccccacccccgggacgatgttgttccgcgagattctcctcgggcagatggggtacaccgagggtcagggggtgtacaacgtcgtccggtccagcgaggccgccacccgacagctgcaggcggcgatcttccacgcgctcctcaacgccacgacgtaccgggacctggaggaggactggcgccgccacgtggtggcccgcggcctccagccgcagcggctggttcgcaggtaccggaacgcccgggagggcgatatcgccggggtggccgagcgggtgttcgacacgtggcgatgcacgctcaggacgacgctgctggactttgcccacggggtggtagactgctttgcgccgggcggcccaagcggaccgaccagcttccccaaatatatcgactggctgacgtgtctggggctggttcccatattgcgcaagacgcgcgagggggaggcgacgcagcgcctgggggcgtttctcaggcagcacacgctgccccggcagctggccacggtcgccggggccgcggagcgcgccggcccggggcttctggatctggccgtcgcgttcgactccacgcgcatggcggaatacgaccgcgtgcacatctactacaaccatcgccggggggagtggctggtgcgcgacccggtcagcgggcagcgcggcgagtgcctggtgctgtgcccccccctgtggaccggcgaccgcctggtcttcgattcgcccgttcagcggctgtgccccgagatcgtcgcgtgccacgccctccgggaacacgcgcacatctgccgtctgcgcaacaccgcgtccgtcaaggtgctgttggggcgcaagagcgacagcgagcgcggggtggctggcgccgcgcgggtcgtcaataaggcgctgggggaggatgacgagacgaaggccggctcggccgcctcgcgtctcgtgcggctcatcatcaacatgaagggcatgcgccacgtgggcgacatcaacgacacggtacgcgcctacttggacgaggcgggggggcacctgatcgacacccccgccgtcgaccacaccctccctgggttcggcaagggcggcaccggccgcgggtcggcgccccaggacccgggggcgcgaccgcagcagcttcgccaggcgtttcagacggccgtggtcaacaacatcaacggcatgctggagggctatatcaataatctctttggaaccatagaacgcctgcgagagacgaacgcgggtctggcgacccagctgcaggcgcgcgaccgcgagctgcggcgcgcccaggcgggggcgctggagcgggagcagcgcgcggcggaccgggcggccgggggaggcgcgggccgcccggcggaggcggatcttctccgggccgactacgacattatcgacgtcagcaagtccatggacgacgacacgtacgtggccaacagtttccagcaccagtacatccccgcgtacggccaggacctcgagcgcctgtcgcgcctctgggagcacgagctggtgcgctgcttcaagattctgcgccaccgcaacaaccagggccaggaaacgtcgatctcgtactctagcggggcgatcgcctccttcgtggccccgtatttcgagtacgtgcttcgcgccccccgagcgggcgcgctcatcaccggctccgatgtcatcctaggggaggaggagttatgggaggcggtctttaagaaaacccgcctgcagacgtacctgacagacgtcgcggccctgttcgtggcggacgtacagcacgcggctctgccccggcccccctccccaacccccgccgatttccgggcgagcgcgtccccgcggggcgggtcccggtcccggacccggacccgatcccggtcgcccgggagaacgccgaggggtgcgccggaccagggctggggcgtcgaacgcagggatggccgaccccacgcccgccgatgagggaacggccgccgccatcctcaaacaggccatcgccggggaccgcagtctggtcgaggtggcggaggggatcagcaaccaggcgctgctgcgcatggcctgcgaggtgcgccaggtcagcgatcgccagccgcggtttaccgcgaccagcgtcctgcgcgttgacgtcacccccagggggcggttgcggttcgttctggacgggagttccgacgacgcgtacgtggcgtcggaggattactttaagcgctgcggggaccagccgacgtatcgcggttttgcggtcgtcgtcctcacggccaacgaggaccacgtgcacagcctggccgtgccccccctcgttctgctgcaccggctctccttgtttcgccccacggacctccgggacttcgagctcgtctgcctgctgatgtacctggagaactgtccccggagccacgccacgccctcgctgttcgtcaaggtgtcggcgtggttgggggtcgtggcccgccacgcgtctcccttcgagcgcgtccgctgccttctcctccgcagctgccactggatcctgaacacgctaatgtgcatggcgggcgtgaagcccttcgacgacgagctagtcctgccccactggtacatggcccactacctgctggccaacaatccgccccccgtcctctcggccctgttttgcgccaccccgcagagctctgcgttgcagttgcccgggcccgtcccccgcacggactgtgtggcctataacccggccggcgtcatgggaagctgctggaattccaaggacctgcgttcggctctggtgtattggtggctttcggggagccccaaacgacggacctcgtcgcttttctatcggttttgctaactccggaaaataaacgtgttttttatggaacgttccccacctgtcgtgtcatctctcgggggatggtggtgggcctgtgtgtgtgtcttgtgcaccgaaggaggaaagtgggggggtggtggtgctggtggtggaaagacatgatagagggaacaaagaaatagaagaaaaccacaaccggcgcgtgccagtaaatacggacgcgcgcacacgcggggggtaagttggagcacggggccccggtttattgaccaaattcagggaaacagaaaccgcatcttttcctcgaaagggtacacaaagctcccgccctcgccccacacgccttccagaacccccgtaaacaccagttgaatctcgcgcaggatctcgcgcaggtgatgggcgcagtccacgggggggagcaccaagggccgcgggtacagatccacggggacgccgaccgactccccgcccccgggacatacgcgcacgacgcgtctccagtattgctccgcgtccagcagggcgcctccgcggaaggccgtttggggcagggggtcgtcggcctcgcctgggggggtcagaacgctccagtactccgcgtccagacgcctcccgaaggcatccaggacaaagcggtcacaggcgtcctccatgacgccccgggccgcgcacacggcctcctccggcgggccggcggccggccgccggaggattcgtctcagcgcgtcgcgcataacctcggccgccgcggcgtacgcgggcccgcggagaggaaatccctgcaggaagtcggtgtcatcgcgggagttccagaaccacgccccggtctggctccaggtgacgacgtgggtgtagacgccctctggcgccagggagggggcgaggcgcgggcgtatgccgttggccgaaagtacggcgcgcacggacgcctcgagggcccggcgggcgtcctggatcgcgccgtgcgcggcgtccgcgtccccggggtccacgttgaacagcccccagaacgcagccccggtgccgccgcagaccgcaaacttcaccgagctggccgtctgctcgatctgcaggcagacggcggccatgaccccgccgagcagctgccggagcgcggggcaggcgtcgcacgcgtccggcaccaggcgctccagcacggcccgggcccagggctccgagggggcggccgccaccagcgcgtccagcctttccaggcccgcccgcccccgggcttccggcagcccggcctccccgaggcccgcgagggcggccaggagctgggcctggagcccggagaaacaaaaccgcgccgtccagaccggcccgacggccgccggggggtcgagtagttggatggtggtggccgtggggtgccaccgcgccaccgcttcccgaaaggcgggcaggaggcggccggccgcctccgaggccacggccggccatgcccgcgggggcaggacgaccctggcgcccaccgcgggccaggcccccaggcacgcggcatgggtggccgcggcgccccgcaccaggtcacgcgccgactcggcggcggcggcggccggcacggtaaacgtgggccagcccggaaatcccagcacggcaaagtattggacgggccctccccggacctcaaacccgggccccagaaaagcgaagacgggggccagggctccgggggcggcgtggaccgtggtatgccactgccggaagagggcgaccagcgccggggcggagaacccgtcgccggcgctcacgaagtagtcgtagccgcgcggcagcagcacccgcgccgtgacccgctgcgggtgtccgcggggccgcaggccgacctcgcacacctcgaccaggtccgcgaaggcgccctccttcctggtcggcggaaacgccagggtggtgtattcgcgcgcaaaacgcgcggtcctcgtcgtgatggtgacggcgagcgaggcggaggacgcgcactgggggctgtcgcgaatggcggccaggcgcgcccacgccaaccgcgcgccggggtgctcggcgacgcgcgcggacagggccagcgggtcgacgtcgaccttggcctccacgtccaggagggcggcgcgaggagcggccggcgggccccacgacgccctttcgaccctcacgaccagacccgtctgcgggtcccagcccaggcgcagcgggacgaagagggccaccggccccgtctggcgctccagggccgccagaacgcacgcatacagcgcccgccacagggtcgggtcccccaggggctccagcggggaggcggccggggccgtcgcggcgcgggcggccgcgacggccccggcggccgagacgtcgggggagccgtagaagtcctgcaggtcggacgaaccaacggacacctccgcgaagcgcgcgcgcgcctcccccgcggcgtcgcgacagaccagatacagcagggcgtggaggcagtcgcgcgtgcgcgggggcagccataccgcgtatagggtaatggcgctgacgctctcctccacccaaacgatgccgggggcttccatgccacgacgcccgggggttgccgtgtatcgaacgagcgcggccccagacttatagggtgctaaagttcaccgccccctgcatcatgggccaggcctcggtgggaagctccgacagagccgcctcgagaatgatgtcagtgttgggctgggcgccggaggcgtgcgtgcgcaagcagcgcccccacgcgggcgcgcgcagcttgaagcgcgcgcccgcaaactcccgcttatgggccatcagcagcgcgtacagctgtctgtgcgtccggcaggcgctgtggtcgatgcggtgggcgtccagcagctccacgatggctcgcttggtgaggtttttaacgcgccccgccccgggaaacgtctgcgtgctcttggccagctgcaccccgaacagttcgccccagatgatcttgaacagcgacagcgcgtgctccgtctcgctcacggacccgcgcggggggcagccgctcagggcgtcggccacgcgcttaaccgcgtcctccgacagcaaggggccgtcggtcacgttacagtggcccagttcgaacaccagctgcatgtagcggtcgtagtgggggttcagcagctccagcacgtcctcggggctaaaggttcgccccgaccccccggccatcgagtcccactgcaggcacgcggccatggtgctgcacagacggaacagctcccagacgggggcgacgtttagggtggggtgtagggccacaagctccagctctccggcggcgttgatcgtggggatgacgcccgtggcgtagtggtcgtaaagccgccggaagatggcgctgctatgggcggccatggggacgcgaagacaggcctccagcagcaccaggtagatgaaccgcgtgcggccgaccaggctgttgaggccgcgcatgagcgcgaccacctcggccggcgcgacgtccggccggaggtacttttcgacgaaaaggcccacctcctccgtctcggcggcctgggccgacagggacgtgtcggggtcctggcagcgcagctcccgcagatcccgctgggccctcagggcatcaaaatgtatcccccgcaaaaacagacaaaagttcctcggggtcagcgcggcgtcgtggccccagaaccgcacgtgcatgcagttgagggtcagaagcatgtggaggatgttaagactgtccgcgaggcacgccagcgtgcacctctcgaagtagtgcttgtaccggaatttgctgtagatgcgcgacccccgcgcctgcgccgcgtcggcgtgcgacgcgtcgcagcgccctttgaaccggcggcacaacaggttcgtcacctgggaaaactgtgccggccactgcccgctggcgctcaccacgtggttgagcagcatgggcgtaaagacgggctccgagcgcgccccggacccgtccatgtagatcagcagctcccccttgcggagagtccgtacccgccccagcgactggtacacggacaccatgtccggcccgtagttcatgggtttcacgtaggcgaacatgctgtcaaagtgcggcggatcgaagctaaggcccaccgtcacgaccgttgtgtagatgaccacccggtaccggccccatgtggtcacgtcgccgggcggggtgagcgagtggagcagcagcacgcggtccgtaaactgccggcagaacctggcaacgacctccgcgaaggagaccgtcgacgagaagatgcagacgttatctccgccggccaggcgcgcctccagctccccgaagaaggtggcgtccgggggggcgtccggggggggcgccccgcccgccggccccggcgggcgcagggccgcctgcaggacctcgggccccaggcgcgggagaaacagacaacggcgcgccgaaaatccgggcatggcgtactccccgatgaccacgtgaacgttcttttcgccccggaggctgcacagaaagtccaccagctgcgcgttggcggtggcgtccatggcgatgatccgcgggcacgtgcgcagcaggcgcagcatcaacgcgtcgacgcggcccagctgctgcatcgtcggcgagtacagttggcccaacgtcgacatgacttcgtccaggacgagcacgtcgtagttgttcaacaggttcgggcccacgcgatgaagactttccacctgcacgatgagacggtggaaggggcggtcgttcatgatgtaattggtggatgagaagtaggtgacgaagtcgggcaaccctgactcagcgaaccgcgtcgccagggtctgagtaaaactccgacgacaggagacgaccagcacactcgtgtccggagagtggatcgcttcccccaaccagcggatcagcgcggtagtttttcccgagcccattggcgcgcggaccacagttacgcaccgggccgtcggggcgctcgcgtccgggaaggtgacgggtccgtgttgctgccgctcgatcgttgttttcgggtggacccggggaacccactcggccaaatcccccccgtaaagcatccgcgccagcgatacactcgacgtgtactgctcgcactcgtcatccccgatgggacgccgggcccccaggggatcccccgaggccgcgccgggcgccgacgtcgcgcccggggcgcgggcggcgtggtgggtctggtgtgtgcaggtggcgacgttcatcgtctcggccatctgcgtcgtggggctcctggtgctggcctctgtgttccgggacaggtttccctgcctttacgcccccgcgacctcttatgcgaaggcgaacgccacggtcgaggtgcgcgggggtgtagccgtccccctccggttggacacgcagagcctgctggccacgtacgcaattacgtctacgctgttgctggcggcggccgtgtacgccgcggtgggcgcggtgacctcgcgctacgagcgcgcgctggatgcggcccgtcgcctggcggcggcccgtatggcgatgccacacgccacgctaatcgccggaaacgtctgcgcgtggctgttgcagatcacagtcctgctgctggcccaccgcatcagccagctggcccaccttatctacgtcctgcactttgcgtgcctcgtgtatctcgcggcccatttttgcaccaggggggtcctgagcgggacgtacctgcgtcaggttcacggcctgattgacccggcgccgacgcaccatcgtatcgtcggtccggtgcgggcagtaatgacaaacgccttattactgggcaccctcctgtgcacggccgccgccgcggtctcgttgaacacgatcgccgccctgaacttcaacttttccgccccgagcatgctcatctgcctgacgacgctgttcgccctgcttgtcgtgtcgctgttgttggtggtcgagggggtgctgtgtcactacgtgcgcgtgttggtgggcccccacctcggggccatcgccgccaccggcatcgtcggcctggcctgcgagcactaccacaccggtggctactacgtggtggagcagcagtggccgggggcccagacgggagtccgcgtcgccctggcgctcgtcgccgcctttgccctcgccatggccgtgcttcggtgcacgcgcgcctacctgtatcaccggcgacaccacactaaatttttcgtgcgcatgcgcgacacccggcaccgcgcccattcggcgcttcgacgcgtacgcagctccatgcgcggttctaggcgtggcgggccgcccggagacccgggctacgcggaaaccccctacgcgagcgtgtcccaccacgccgagatcgaccggtatggggattccgacggggacccgatctacgacgaagtggcccccgaccacgaggccgagctctacgcccgagtgcaacgccccgggcctgtgcccgacgccgagcccatttacgacaccgtggaggggtatgcgccaaggtccgcgggggagccggtgtacagcaccgttcggcgatggtagccgtttcgttcgttttaataaaccgacgttgtgcgtttcaccatacttcggcgcgcgtgtgtgtgtgtttttttttttgtggtgtttattttccccccaccccttccttttctttcggccaccacccccctcctcccccgtactatacaacaaaaaataccacacatacgaccaaatacggacaatcatttctgtctttattcgctatcagagagtgggggcgtgagcgtggcaggagggcgggccacgtcggggtcccgccgtctggtgtgacgcgatggggggtccgatgcgcgccggtactggggccccggcgcccgggtgaccacgcgcacgtcggggggcacgtagaagttaccctcttcttcggactcgatgtccacgacgtcaaattcgtgggcggtcagcgagacgacctccccgccgtcggtggtgatgacgttgtgtcggcagcagcagggccgcgccccggagaacgcgaggcccataacttggcgagcgtatcgtcgaaggccaggcggctgtttcgccggatgtcccggtagatccccggctcgacgcggacgggggtgatgatcagggcgatcggaacggcctggtccgggaggatcgatgccttggcgggtccgggggccccgccacgcccggcgggcgctccgcggccgtcctccaggcggaacgtcacgccctcctccgcgcccgcgcggtgcctgccgaggaacgtcaccaggtgcggttgcagggggcagtcgggaaagtggctgtcgaggacgtatccctgcaccaagatctgtttgaagttcgggtggcgggggttggcgaagatgggctcgcggcgaaccagctccccggagctccaggccacgggagagatggtgcgacgctcaaggtcggggacgccaaacagaagcacctccgagacaacgccgctatttaactccaccagcgcccgatccggggcggagcatcgccttttttcgccggcggcgcgggaatcgagccagtcccggtcttgggtgacgagcgcctcctccgggcccggaacgcgcccgggcgcgaagtagcgcacgccggggttggggatggaccggatgaacgcccggaacgcctccggcgatcgccgcgccatcaggtcctcgtacgcggaggccgcgggggcgccggggtccgcggggtcgaacgcgtacttggctcggcacttaacctcgtagaaggccaggggggtctggggggcgggggccaggtagccgtgagggtccctggggcacacgaggatgtccagggacgcccccaccatgcccgtgtggccgtccatgaggaccccgcacgcgtgcacgttctcctcggcgaggtccccgggttggtgaaagacgaagcgcccggcgtcggcgtcgtcgttgacgcccgcgtccgcgcggcccacgcagtagcgaaacagcaggtttcgggccgtcggctcgttcacccgcccgaacatcaccgccgacgactgggcgtccagccgcaggctggcgttgtgggtgagccactgggacgagaagcacggaccctgcgcgccccaccgcagcgtggaggcggtcgtcaggccccgccgaagcagggcccagagctggcagtcggcctggttttgcgtcgccgcctcgtaaaatcccataagcgggcggggggcgacggcttcggcggcggacgggggggcgcggcgcgtcaggcgccagaggtgccggccgagcccgcggtccaccatgccggccgcctccagcgacacgacgagggagcacagatagtccaggcgagcccacaggggcccgatggccagaggggagcggacgccgcgcagcaggccgcgcaggtggcgctcgaacgtttccgccaagatatgggggggcagtgcgttggggatcgccgacgccgaccacatcgggtcggggtccgggggaccggggctgcagtccgggtcgatggcgtgtgcgccccccggcgagaggggaatgtcgggggttggcgggccggatgaggcctcagagagggccggggacgcgggccgggccttttcgcccggggccccgccgtcgggttgcccacgtggggggctctggggccaatgggaacccggggcccccggtgacgtggggcggggtggggcggggcggggcccaaagacggtcgccagatctaggctgttgggtcggggccgcttcgggggactatcggggtcgcgggcggggtccgcggggcgcttggcgccgggtgttgcggcggccgccatttttacgagcagccgaagagctcgagggcggaagggatcctcacgacagagagtggcgcgcggccgggttggcgtgacagaggcgggagaccagcaccagcagcggcctcagctcgggcggcagcgacaccgacgacaggacggccttgtgcgtgcgctggtaatttatacactgctccgtgaacgcgcgccgaatcttgggattgcgaaggtggcgccggatgccctccggcacgtcatacgccaggccgtgggtgttggtctcggccgagttgacaaagagggcggggtgcagaacgcagcgataggcgaggagggccacggcaaagtccggcgagagctggttgttaaagtactggtagcccgggacgcgggtcacggggacgcccaggctcggggccacgtacacgctaaccagcagctccagcagcgtctgccccagggcgtagagatcgaccgccagcccgacgtcgtgcttcagggggcggttgttaaactcggcccgctcgttgttgaggtactttaccgagagctccggtggctggttgtacccgtgccccaccagagtgtgaaagttggccgtggtcagggcggcgggcatcccaaacccccggggggactcgaggtccggctcctggaggcaaaactggccccgggatatcgtggagttggagttcagggtcaccaggctaaagtcggccaggacggcccgccggagcgacaccgcgtccgatcgcagcatcacgaggacgttggcgcacttgatgtccaggtggctgatcccgcacctggtgttcaggaacaccacggcgcgcgccaggtctgtgaagcagtggtggagggccgtcgcgacggagggggtggtcgcgcgcagggacgccagctggccgatgtacttgccgaggtccatgtcgtacgcggggaacacgatctggcgctgctgcagcgagaacccgagcggggtgataaagccgcggatgtcgtgggtgcggccgccgcgaagagcgcactcccccacgagcagggtcgcgacgagctccacggcaaaccactctttttcccggatggtcttcacggcgagcttgtgttcgcgaatcaactgcacctcgccgtacccccccgagcccccgaagctgcgggccccggggatctccagggtcgtgtagcggagggcggggttgacggcgaatacggggatgcatagcttgtggatgcgcgcgagggacaggatgtgcgaggggggcgacgggggcgaggtcatggccgtctcggacctgcgcaggggcgggcgccttagcttggccgcagggccgggggcctcgggggacgagcggcgacgagacgagcggctcactcgccatcgggacagtcccgcgcgaagccgctcccggaagctggatcggcggcgggacccggggcgggctccggagacggcgccgtctcggggggaggggccgcttgggcgtccggacgcccggcggctgagggagtgtatgtaggacgcgagccaggccttgaaggagcgtcggtgtgcaccttgggggctgatgtcagctgccacatgactagcaggtcgctgtcgcccggactcatccatccgtccgccaggtcgccgtccccccacagagacgcgttcgccgcggcctcttcgagctgctcctcctggtccgcaagacgatcgtccgccgcgtccaggcgctcgctaagcgcgggatcgaggtaccgtcggtgtgcggttagaaaatcacgtcgcgccgcttgctcttccacgcgaattttaacacaggtcgctcgctgtcgcatcatctctaagcgcgcgcgggactttagccgcgcctccaattccaagtgggccgccttggcggccataaaggcgccaacaaacctaggatcttgtgtactcacgccctcccggtgtagctgcagggtctggtccctgtacacctcggcccggaggtgcgtctcggccaaacgtcggcgcagggccgcgtggctggcgtctcggctcatctcgccgcccccgcgcgcgcccgacgtcggactccttcgccccgacccccctgacctcagccgcccccgcctcgcccgcgatgtttggccagcagctggcgtccgacgtgcagcagtacctggagcgcctggagaaacagaggcaacagaaggtgggcgtcgacgaggcgtcggcgggcctgacgctcggcggcgatgcgctgcgcgtcccttttttggattttgccaccgcgacgcccaagcgccaccagaccgtggtcccgggcgtcgggacgctccacgactgctgcgagcactcgccgctcttctcggccgtcgcgcggcggttgctgtttaatagcctggtgccggcgcaactcagggggcgtgactttgggggcgaccacacggccaagctggagttcctggcccccgagctggtgcgggcggtggcgcgcctgcggtttcgggagtgcgcgccggaggacgccgtgccccaacgcaacgcctactacagcgtcctgaacacgtttcaggccctgcaccgctccgaagcctttcggcagttggttcacttcgtgcgggacttcgcccagttgttgaaaacctcgttccgggcctctagtctcgcggagactacgggccccccgaagaaacgggccaaggtggacgtggccacccacgggcagacgtacggcaccttggagctcttccagaaaatgatactaatgcacgcgacctactttctggccgccgtgctgctcggggaccacgcggagcaggtcaacacgttcctgcggctcgtgttcgagatccccctgtttagcgacacggccgtgcggcacttccgccagcgcgccaccgtgtttctagtccccaggcgccacggaaagacctggtttttggtgcccctcatcgcgctgtcgctcgcgtccttccgggggatcaagataggctacacggcccacatccgcaaggcgaccgagcccgtgtttgatgagatcgacgcctgcctgcggggctggtttggctcgtcccgggtggaccacgtcaagggggaaaccatctcgttctcgttcccggacggctcgcgcagcacgatcgtgtttgcctccagccacaacacgaacgtaagtacgccttcctcccgcggtgcctgtttccccggtgccgccctccccgagatcgaccgacagacaaacacagccagacgcgagtgtgggacgacacgcccgcagccccccccccgccatggcgggggggaagccttactgtttatttgtaatcggacgatgaggctctggccacggcccgcgcgaccgcggggcagctcgttgcaaacaggcggctggtatacgatgacagaacgcagaggcgccacccggcgctggtcgggcggatgacgctttccgcgccgtcccggcccacgacgacctcgtgcaggtgggccgtgatgcgcgggcggcgggtcgcctgccgcaggataaccgcgtccacggggtgcccgaagaggagctgacacaggctcgcgtccccccggacggccagggtgcgctgggccatattggaccacatgcacggggcgacgcagggacaggcctccgccacggcgggggcgcgccacagcgcgttggcggaatcgatgtgggccgtcggggcgcaggcgccgcctcctcccggggggtcggtaatcctggatagcagccatcctaaatggcgggcccggctgcccgggggacagagcgaccccaggtcatcatccatggcccagcagtatatgcggccgccggggaggtgccaccaggcccccggacccagggcacagcacgcccccggattcgggggcggttccgtgggtaccaggtaggcgccgtcgagctcgtgggccacgggctcgtccgcgagctgttcggcggcggggtcgggggtttcctccgggggggaggcagcttccaggtggccgaaggctagggtgcacagcagcggggtccgggggtgcgttacgctgcggaggtggacggtggcgcagtagcggcgctcgcggttaaagaagaaaatggcaaagaacgtgttcgaaggcaggcgcagcgccttgggccgcgtcaggtacaggaagatctcgcagaaaagggcacgctcggggtcggggtccggaagggccacctggcacagcggctcggtgaggaccgtgaggcaccgaaaaatcttaagccgctcgtccccccgaacgacgcgccacacgaagacagagttggcgatgcgcgcgacgaggtcggcttcgggccccgggtcgggggcgcgcgcgtcggggggggcgccccggtgacccggcggggccgcggctcccggggggcctggcgtcgcctggggacgccagagtgcccgctgtgccaggttggtggtggggaagggaccggagacgcaccaaaagcagaggggccagcgcgtgtatgagttggggggggggtgggtgagcggtggaacaaaagcacgcgtcagcggacaaggccgggtcccgtagccgccccgcgacagaaccggagtccgacggcacgcgcgacggggtctgcgaggctgaggtacgccgcggtgttaatggtaaacgcaaagcctcccggaaagaccactagcccgcagaggcggcgattgaacccaaggcagaggtacgcgtagctctctcccggaaggtattgctcgcagaccctgtgtggggcagtggaggggctgccctccatgaagcgacatttactctgctcgcgtccattgacgtcaccgtcaatcaccactgcgattggacggttggtgaggcgcagcgtgtctccgctggtgctgtagtagtcaaacgcgtagtgggcgtcggagtcggcgaagcgggcggggatgtcgtcgctgagagggacgagccgccgccgccgcccccgaccgccctggccgcccagatgcgccagcacggccagggcgtacgcggtgtgaaagaacgcgtcgggggcggtcccctcgagggcgcgcatcaggttctccaggagcacggggaagcgccgcgtcacctcccctagccactcgctctggtgggggccaaagtcgtagcgcaggcgctggaagatgcgcgggccgccttggagcgcggcccggatagagtggcccagggcccgcagacacgcgatctggatgcgcgcgacgaaggccacctcggccgcgatgtcaaagggctgcagcacggggcgcgggtggcgcaggggtccctcgagcgcgggaaagcgacgcagcagcgccgtctgggccgcgggggacagctggtgggggcgcacgacgcgctcggcggcacaggcctccgtcagggccgtggccagctcggaggacagccgcggggggcgggcgcgtcgcccgccccacgccaccgaattctcgtaggagacgacgacgaagcgctgcttggtcccgtagtgatggcgcaggaccacggagatggagcgacggctccacagccagtcgggccggtcgccgccggccagagcttcccacccgcggtccagccactcgaccagcgatcgcggcttggcggtccccggcacgagggtgagcacgtcgttgaggacgtcctcgcccgcggcccgggggccccccggggtggcaaagcgccccccgccgggcggctccaggcccgccagcaccgcctccgcgtccgacgcgcccagggctcccccgctgacggcctggtggaccagggcgccctggcggagccccgaggcgacgccggaggccgcgtgcttggggcgcgcgcggaccgggtggcggcgggtgacgtcctgcacggcccgctggaccagcgcgaggatctcctcgttctcttgcgtgatggacacgtcctccgcggtggccgtgtcgcctcccggggccgtgagctgctcctccggggagatgggggggtctggggtgccgacaacggccggcccggccccgcccgagaccgaggacgcctggggagtgggggtgccgctttcccccatccccagggacaggtgggccgccgcctccgtcgcggcggcgggagccgcggcccccagccgcgcgacgtagcgacaaaagtggcgacagaggcgcatgaggcgcgcgccgtcggccgcgtatcgcgtgtttggcgggacgagctcgtcgtaactgaacaggagcacgcgggcgcaggtcgcccacgggccccacgccaggcgcagcgccgcgaccgtgtacgggtcgtacacgccttgggcgtcgcacgcgaccggcagggagacgaacagcccgcccgcgctggggacgcgcggcaggaggtccgggtgcgccgggatgacgggggctaggatcgcccccaccgcatccgccggcacgtaggcggcaaacgccgaacgccacggggtgcagtcgccggtcgcgtgggcccgggtctgggtttcgacccggaagttcgcggccgccccaccgtcggggcggccgcgcacgagggcggacagcgggacccccgccgccgccaggcactcgctggagatgatgacgtgaatcagcgaggcggggctgctcgggtcccgggtgagatcgtattggacctcgttggcaaagtgcgcgttcatggcccggccggcggtgcgagcccttcccggtgccggaaggggcgtgggtggggggtgcgtgtgcgcgtcctcggggcccgcgggcgcacgtgcgcttatacgctgtgtgtttcgtctgtccccagggaatccggggccaggactttaacctgcttttcgtcgacgaggccaactttattcgcccggatgcggtccagacgattatgggctttctcaatcaggccaactgcaagatcatcttcgtctcgtcgaccaacaccgggaaggccagcacgagctttttgtacaacctccgcggggccgccgacgagctgctcaacgtggtcacctatatatgcgacgaccacatgccgcgggtggtgacgcacaccaacgccacggcctgttcctgctatatcctgaacaaacccgtgtttatcacgatggacggcgccgttcgccggacggccgatctgtttctgcccgactccttcatgcaggagatcatcggggggcaggcccgcgagaccggcgacgaccggcccgtcctaacaaagtcggcgggggagcggtttctgctgtaccgcccctccaccaccaccaacagcggcctgatggcccccgagctgtacgtgtacgtggacccggcgttcacggccaacacgcgcgcctccggcaccggcatcgcggtcgtcgggaggtaccgcgacgatttcattatcttcgccctggagcactttttcctccgcgcgctcacgggatcggcccccgcggacatcgcccgctgcgtcgtgcacagcctcgcccaggtgctggcgctgcaccccggggcgtttcgcagcgttcgcgtggcggtcgagggcaacagcagccaggactcggccgtggccatcgccacacacgtgcataccgagatgcaccgcatcctggcctcggcgggggccaacggcccggggcccgagctcctcttctatcactgcgagccgcccggcggcgcggtattgtaccccttctttctgctcaacaaacagaagacgcccgccttcgaatactttatcaaaaagttcaactccgggggcgtcatggcgtcccaggagctcgtctccgtgacggtgcgcctgcagaccgacccggtcgagtatctgtccgagcagctcaacaacctcatcgaaaccgtctctcccaacaccgacgtccgcatgtactccggaaaacgcaacggtgccgcggacgacctcatggtcgcggtcatcatggccatttacctggcggccccgaccgggatccccccggccttttttccgatcacgcgcacgtcttgagtctttcttgccgtttcttttgtttctctttctttccccccctctctccgcaataaacgccttcccggaactgtgtttccccccctacaacagtgttgtccgttggttgggtggttggggtgcgggggtgggcgggggaagcaagaaaacggtcggcgaacacaacatcgggaaaacggattcccgcacgtgcgtcttcccagattcgacacacacaccccccttctccttaaataaacacaaaccacacgctcgttggttggttaatgccagcgctttatttacgtcttgttttttttgcgtttcctccgcgggtcccttcccaacacgcctgcccccgcctcaggggtagcggataaccggggccatgtcgccggattgcacaacggcggcgccgtcgaacgtacacacccgaaccgccggggccagggccaggatgtccccgagttggcccgcgtgcgccagccaggcgaccagcgcctcgtaaagcggcagcctgcgttcgccgtcctgcatcagcatgggggcttcggggtggatgagctgggcggcttctcgcgtgacgctctgcatctgcaggagcgcgttcacgtatccgtcctgggcgctcagcgcgagcagccgggggatgagcgtgaggatgagggtggttccttcggttatggagtagaccatgttgaggacgagcgaccgcagctcggtgtttacggaggcgagttgctggacgtcggccacgagcgagagacgggccccgttgtaatacagcacgttgaggtcggggagctccccgggcgtccgggggtcggggttgaggtcccggatgccccgggcgaccagccgcgcgactatctcgcgggccaggggcgttgggagcgggaccggaaaccgcagcgtgaggtccagcgactccaggcgcacgtccgtcgcctggccctcgaagacgggcgggacgaggctgacgggatccccgttgcagaggtcgacgggggaggtgttgcggagattgacggtgccggcgtgcgtgagccccaggtccacggggcaggcgacgattcgcgtgggcagcacccgcgtgattaccgcggggaagcgcctgcggtacgccagcaacaaccccaacgtgtcgggactaactcctccggagacgaacgattcgtgcgccacgtccgcgagcgccagctggcggcggatggtcggcagaaagaccactcgaccctcgcaccgctgcagcgccgcggcatcggggcgcgagatacccgaggggatcgcgatgtctgcttcgaaacaatccgtgatcatggcgccgggccgcgagacaccggaacgcgggggtgcgggagggccggaaagcgcaacgcaaccgggacgatgatgaaacagagatggggggcaccgaccgtgtgggagagggggcggggcagggctcagcagcacgcacggggaggtctgtcgtgcgcaggagccccaggtgagaatcagtcccccggagctcgggtctgggttttattgggacctgccctcggaatcgcggctcccagtccaagcccccctggggggggcggggacagggggtgtgtgtgggtaaaagcaacgtcggaaaatcaaacccaatgccccaaacaggaaaaaaaaagacgggcgggtggagggaaagctggggaagaagaagccaattttacagagacaggccctttagcggggaggcgtcgtagatgagatactgcgtaaagtgggtctctcgcgcgtgggcctccccatcgcgggcgctgcgtagcagggcggggtcgctggcgcaggtgatcgggtaggcttcctgaaacaggccgcacgggtcttccacgagctcgcggcaccccggcgggcgcttaaactgcacgtcgctggcagcggtggccgtggataccgccgatcccgtttccacgataagacgctccaggcagcgatgtttggccgtgatgtcggccgcggtgaagaacttgaagcaggggctgaggacgggcgaggccccgttgaggtgataggccccgttgtacagcaggtccccgtacgagaaccgctgcgacgcccacgggttggccgtggccgcgaagggccgcgccgggtcgctctggccgtggtcgtacatgagggctatgacgtccccctccttgtcccccgcgtacacgccgccggccgcgcgtccccgcgggttgcagggccggcgaaagtagttgatgtccgtggccacgggggtggcgatgaactcacacacggcatcctgcccgtggtccatgccggcgcgccgcggcacctgggcgcagccaaagaccgggaggggctgggccggccccagccggtttcccgccacgaccgcgttgcgcaggtacacggcggccgcgttgtctagcagcgggggggccccgcggccgaggtaaaagttttgggggaggttgcccatgtccgtaacggggttgcggacggtggccgtggccgcgacggcggtgtagcccacacccaggtccacgtttccgcgcggctgggtgagcgtgaagttgacccccccgcccgtttcgtggcgggccacctggagctggcccagaaagtacgcctccgacgcgcgctcggaaaacagcacgttctcggtcacgaagcggtcctgccgcacgacggtgaacccgaacccggggtggaggcccgtcttgagctggtgatacagggccacggggctcatcttgaagtaccccgccatgagcgcgtaggtcagcgcgttctcccccgccgcgctctcgcgggcgtgctgcaccacgggctggcggatggaggagaagtagttggcccccagggccggggggaccagggggacgtggcgcgccaggtcgcgcagggccggggggaagttgggcgcgttggccacgtggtcggcgcccgcaaacagcgcgtggacgggcaggacgtagaagtattcgccattttggatggtgtggtccaggtgctggggggccatgagcagcacgccggcgtgcagcgccccgtcgaagatgcgcatgttggccgtcgacgcggtgttggcgcccgcgtcgggcgccgcggagcacagcagcgccgtcgtgcgctcggccatgttgtgcgccagcacctgcagcgtgagcatggcgggcccgtcgacgacgacgcgcccgttgtggaacatggcgttgaccgtgttggccaccagattggcgggatgcagcgggtgggcggggtcggtcacgggatcgctcgggcactcctcaccgggggcgatctccgggaccaccatgttctgcagcgtggcgtacacgcggtcgaagcggacccccgcggtgcagcagcgcccccgcgagaaggccggcaccagcacgtaatagtagattttgtggtggacggtccagtcggccggccggtgcggccggtcgtcggcggcgtcggccgcgcgggcctgggtgttgtgcagcagccggccgtcgttgcggttaaagtcggccgtcgccacgttgcacgccgccgcgtagacgggctcgtgcccccccgcgtcaatccggcagtctcggtggcggtccagggccgcgtgtcgcataaggccgtcgcagtcccacacgaggggcggcagcagcgccgggtcgcgcatcaggtgattcagctcggcctgagcctgcccgcccagctccgggcccggcagggtaaagtcgtccaccagctgggccagggcctcgacgtgggccaccaggtcccgatacacggccatgcactcctcggggaggtcgcccccgaggtaggtcacgatgtacgagaccagcgagtagtcgttcacgaacgccgcgcatcgcgtgttgttccagtagctggtgatgcactgagtcacgagccgcgccagggcgcagaacacgtgctcgctgccgtgaatcgcggcttgcagcaggtaaaacaccgccgggtagctgcggtcctcgaacgccccgcggacggcggctatggtagccggcgccatggcgtggcggccaacgccgagctccaggccccgggcgtcacgaaacgccaccggacacagcgccaggggcaggttgccgttgaccacgcgccaggtggcctggatcgcccccggaccggccggggggacttcgccgccgggaagctcgacgtcggccacgcccgcgaagaagtcgaacgcggggtgcagctccagagccaggttggcgttgtcgggctgcatgaactgctccgcggtcatctggcactcggcgacccaccggacccggccgtgggcgaggcgctgccgccaggcgttcagaaaacgctgctgcatgtccgcgccggggccggccggggccgcgacgtacgccccgtacggattcgcggcctcgacggggtcgtggttcacgcccccgacggccgcgtcgatgttcatgagcgaaggatgacacacggtcccgaccgcgttctccatggacagccgcagaacctggtggtcctttccccaaaaaaacagctgccggggagggaacgcgcggggctccgggtggccgggggcgggcaccaggtccccggcgtgcgcggcgaagcgctccatggccgggttgaacagccccaggggcaggacgaacgtcaggtccatggcgcccaccagggggtagggcacgttggtggcggcgtagatgcgcttctccagggcctccaggaagaccagcctgtcgcctatggccaccagatccgcgcgcacgcgcgttgtctggggggcgctttcgagttcatccagcgtctcccggttcgcctcgagttgctcctcctgcatatccagcaggtggcggcccacgtcgtccaggctccgcacggccttgcccatcaccagcgccgtgacgaggttggccccgttcaagaccatctcgccgtaggtcaccggcacgtcggcctcggtgtcctccaccttcaggaaggactgcaggaggcgctgtttgatggcggcggtggtgaccagcaccccgtcgaccggccgcccgcgcgtgtcggcgtgcgtcaggcggggcacggccacggacggctgcgtcgccgtggtcaggtccacgagccaggcctcgatggcctcgcggcgatggcccgccttgcccaggaagaagctcgtgtcgcaaaagctccgcttcagctcggcgaccagggtcgcccgggcaaccctggtcgccaggcgcccgttgtcgagatatcgttgcatgggcaacagcagggccaggggaggcgccttctccaacagcacgtgcagcatctggtcggccgtgccgcgctcaaacgcccccaggacggcctggacgttgcgcgcgagctgctggatggcgcgcagctggcgatgcaggctaatgcccgtcccgtccagggcctcccccgtgagcagggcaatggcctcggtggccaggctgaaggcggcgttcagggcccggcggtcgatgaccttcgtcatgtaattatgcacgggctgctcgacggggtgcgggccgtcgcgggcgatgaggggctggtggacctcgaactgcacacgcccttcgttcatgtaagccagctccgggaacttggtgcacacgcacgccacggacaggccgagctccagaaagcgcacgagcgacagggtgttgcagtaggaccccagcagggcgtcaaactctacgtcatacaggctgttttcgtcggagcgcacgcgggcgaaaaaatcaaagagtctgcggtgggacgccacctcgatcgtactcaggatggagccggtgggcaccatggccgcggcgtaccggtaacccggggggtcgcgggcaggagcggccattgggttccttgggggattcgcaggctccatcaagccgagctcgggaaggccaagcccctcccgcacaacgcctcaccgccggcggacgcgactaacaacccacgggccgccaaaaccccaaggggcaacccgaccaacaacaggcgaggggaggaaaggcgtaaagggggcgttgggaggcaaaaagaaagaaaacacccagacgtaggcccgaggaccggccggcgtcctctgtccccgagcacccactgtgcccaacaggcacgggggcgagctgcccctgccttatatacccccccgccacacccccgttagaacgcgacgggtgccttcaagatggccctggtccaaaagcgtgctagaaaaaagttggtaaaggcggcaaagcagtccgccgccgccacccacatggcggcgccggccgcgcaggcgattcccagagaacgggcgcggaggggatccgtgcggggcagcagctggctggcggtgatccaatggaaaagcccgtcgggactgaacgtctcatgggcggccgccaccagggcgcacagggccgcgccgcccatgatcacgcacaacccccaaaacacgggtggcgacaacggcaggcgatcccgtttgatgttcacgtacaggaggagcgcccgtgccagccacgtgacatagtaggcgaggacggcggctataatacatgccggcgccaccgcccgtccggtccacccgtaatacatgcccgcggccaccagctccagcggcttgaggaccaggaacgaccaagcaaacatcaccacccgcttggaaaagaccggctgggtgtggggcggaagacgcgagtaggccgaactgacaaaaaaatcagacgtgccgtacgaggacagcgaaaactgttcatcgagcggcagttctccgtcctccccgccacacgcggcctcgtctaccagctcgcgatccaacaaaggaacatcatcccgcattgtcatggtcggtgcggggagccggcgaggcagcaaaaccgaaagtagtgctggcggcgcgggcccgggtccggacccaagcttcagggatggggggcggaggccaaaatcaaacaagcaccgcgcgggttctacacacaacccccacccgggtagtatccgcggatgcgagtgcctggcgaagtcacgtcccagcaggatataaacctcggccgttgggcccggaacccccgaaattcacacccacgccctgacgcccaaatcatgggtggatgtggttcgcgagccgcacatccgtgcgtccgccctcccccgcgggctgatgacgtggcggttagtcagtgggaaggcagggggaaagatgggttgggggaggaaacgaagaaaacacccagagggccacgtcgggaatgcgcccggagttgtccttaaaaggccggccgtgcgtgacggaagccgtcgtttgcccaagcaccgacgccgcgatccacagtggggggagttcctccgtccggccacaaccctacgcgcgggcggcacgcgcgagagcaacccacgggtcccgttcgcgccaccgccagcccttgctcccaccaccctcctcccaccaccccactattcccccccccaagtccgccccgtggctcgccggccatggagctcagctatgccaccaccctgcaccaccgggacgttgtgttttacgtcacggcagacagaaaccgcgcctactttgtgtgcggggggtccgtttattccgtagggcggcctcgggattctcagccgggggaaattgccaagtttggcctggtggtccgggggacaggccccaaagaccgcatggtcgccaactacgtacgaagcgagctccgccagcgcggcctgcgggacgtgcggcccgtgggggaggacgaggtgttcctggacagcgtgtgtctgctaaacccgaacgtgagctccgagcgagacgtgattaataccaacgacgttgaagtgctggacgaatgcctggccgaatactgcacctcgctgcgaaccagcccgggggtgctggtgaccggggtgcgcgtgcgcgcgcgagacagggtcatcgagctatttgagcacccggcgatcgtcaacatttcctcgcgcttcgcgtacaccccctccccctacgtattcgccctggcccaggcgcacctcccccggctcccgagctcgctggagcccctggtgagcggcctgtttgacggcattcccgccccgcgccagcccctggacgcccgcgaccggcgcacggatgtcgtgatcacgggcacccgcgcccccagaccgatggccgggaccggggccgggggcgcgggggccaagcgggccaccgtcagcgagttcgtgcaagtgaagcacatcgaccgtgttgtgtccccgagcgtctcttccgcccccccgccgagcgcccccgacgcgagtctgccgcccccggggctccaggaggccgccccgccgggccccccgctcagggagctgtggtgggtgttctacgccggcgaccgggcgctggaggagccccacgccgagtcgggattgacgcgcgaggaggtccgcgccgtgcatgggttccgggagcaggcgtggaagctgtttgggtcggtgggggctccgcgggcgtttctcggggccgcgctggccctgagcccgacccaaaagctcgccgtctactactatctcatccaccgggagcggcgcatgtcccccttccccgcgctcgtgcggctcgtcggtcggtacatccagcgccacggcctgtacgttcccgcgcccgacgaaccgacgttggccgatgccatgaacgggctgttccgcgacgcgctggcggccgggaccgtggccgagcagctcctcatgttcgacctcctcccgcccaaggacgtgccggtggggagcgacgcgcgggccgacagcgccgccctgctgcgctttgtggactcgcaacgcctgaccccgggggggtccgtctcgcccgagcacgtcatgtacctcggcgcgttcctgggcgtgttgtacgccggccacggacgcctggccgcggccacgcataccgcgcgcctgacgggcgtgacgtccctggtcctgaccgtgggggacgtcgaccggatgtccgcgtttgaccgcgggccggcgggggcggctggccgcacgcgaaccgccgggtacctggacgcgctgcttaccgtttgcctggctcgcgcccagcacggccagtctgtgtgagatatcccaataaagtgcagtcgttttctaacccacggatgccgttgtatgcctatacgggggactatggggggggaaaggaaaggaaacaggaatggagaagggaaaggaacagaggcggtagcggacgcacggcggacacaataacaaacagaccgcggacacggagggagtcggttgggttgggcgtggacgccgctgcgtccacacacccgtttattcgcgtctccacaaaaatgggacgcacgttcggaccaccctaaggatgcccgccagggccgcggtaatcataacgacccccagcgcggacgcggccagaaacccgggggcgatggtggcgatgggcagcgtgtcaaaggccagcagatgaatcacagttccgttggggaacaacaacagggccacggacggcacgtcgctggaaaacacgttcggggtgcccgccaccggcccctgggccagctgctgttgggtggcatccgtgtccaccagcagcaccgacatgacctccccggccggggtgtagcgcagaaacacggcccccacgaggccgaggtcgcgccggttttcggtgcgcaccagccgcttcggctcaatctcccgcgcgtgcccttcgcaggtggcggtgagataggtgataaacagcgggcggcggacgtcaacgcccgtaagcttgtatccgatcccgcggggcaagggggtgtgggtgacgacgtagctggcgttgtgggtgatgggcacgaggatccggggctccgcgttgtgcgacgggccgctacactggtgggtggcctccgggacgaaggcgcggatcagggcgttgtagtgcgcccagcgcgtgagaacggaggccacgccgcgggtctgttgtgccatgacgtccgccgggatgtcggatcgggtggccatggccagcgcgtccaggatgaacccgccctcggcgagatcgaagcgcagggaagctgcgcatggggaaaagtggtccgggagccagaagaggtttttctggtggtcggtcctggctagcgcggcccggagatcggcgtgggtcgccgcggcgacgtcggacgtacacagggccgtggttatgaggaggccccggcgggcgcgttcccgctgctcggccgagggcgcgcccgccaggaacggcgcccggaggacggccgtggcgtaaaacagcgctcggcggaccatcggggcggttagcgcgcggccgccgagaaactcggcgtacagggcgtcgatcaggcgggccgcgctcggggccaccgcgccataggccgcggggctgtccaacacgaacgccagctgatagcccagcgcgtgcgccgccaggctctgctctcgctcgaggatcgcggccaccagatgcccgaggcgcgcctccagccgcaggcgggccgccgggtccaacacggacacgttcaggaacaccgagtcggccgcgcagcccgctgctccccgggcggccaggccggccagcacgcgcgagtgggccaaaaagcccagcaggtcggagaggcgaatcgcgtcgtgggcgtgggccgcgttgacgaacgcaaaccccgacgaggcgagcagccccgcgaggcgccagaacagggacggacgcgcgtccgtgccggagcccgggtcctcccccaaaaactccgcataggcccgcgacatatactgggcgtagttcgtgctctcctcggggtagccggccacccgccggagggcgtccagcgccgagccgttgtcggcgggcgtcggggcccccaggacaaagacgcgatacctggggccggccggaggcccggggagcaccgcgggggcgttttcgtcggtcggatttccgacccgagcgagggtcttgtccgcaggcaccactatgatctcggccggagggctgtcccgcatcgatatcacgagccccatgaagcccttcccgtatcgcgcgcgcacgagcgcggcgtcgcacccgaacgccagcccgcccgtcgtccagacgcccacgggccacgtcgaggccgacggggagaggtacacgtaccgacccggagtccgtagcaggcccctggcggccagccaggtcacggatgcgttgtgcagatgcgcgatgctcaggttcgtcgtcggatgcctcggtgtccccgcgggcggccccgggggcggcgcgttgcgtcggccgtccgggtgcctctcggtcgccccgtcgtctccccgcgggaacgtaagcccctcgcggtccggcgcggccgcgaatgttacccaggcccgggaccgcaacagcgcggaggcgccggggttgtgcgacagtcccttgagctgggtcacctcggcggggggacgggacgtgggccccgcctcggggagctcgggcaggctcgcgttccgaggccggccgagcagataggtctttgggatgtaaagcagctgcccggggtcccgaggaaactcggccgtggtgaccaacacgaaacaaaagcgctcggcgtaccaccgaagcatgggcacggatgccgtagtcaggttgagttcgcccgggggcgccaagcgtccgcgctgggggtcgctggcgtcgggggtgttgggcaaccacagacgcccggtgtttgtgtcgcgccagtacgtgcgggccaaccccagaccgtgcaaaaaccacgggtcgatttgctccgtccagtacgtgtcatggcccccggcaacgcccaccaggacccccatcaccacccacagaccggggcccatggtcgtccgtcccggctgccagtccgcagatgggggggggtgtccgtacccacggcccaaagaggctccgcacctcggaggctatcggaggccctttgttgccgtaagcgcgggccaaaggatggggtggggtgagggtaaaagcacaaagggagtaccagaccgaaaacaaggacggatcggcccgctccgtttttcggtggggtgctgatacggtgccagccctggccccgaacccccgcgcttatggacacaccacacgacaacaatgccttttattctgttcttttattgccgtcatcgccgggaggccttccgttcgggcttccgtgtttgaactaaactccccccacctcgcgggcaaacgtgcgcgccaggtcgcgtatctcggcgatggacccggcggttgtgacgcgggttgggatcatcccggcggtgaggcgcaacagggcgtctcgacacccgacgggcgactgatcgtaatccaggacaaatagatgcatcggaaggaggcggtcggccaagacgtccaagacccaggcaaaaatgtggtacaagtccccgttgggggccagcagctcgggaacgcggaacagggcaaacagcgtgtcctcgatgcggggcagagaccccgcgccgtcctcggggtcggggcgcggggtcgccgcggcgacccccgtcagccggccccagtcctcccgccacctcccgccgcgctgcaggtaccgcaccgtgttggcgagtagatcgtagacacggcgaatggcggacagcatggccaggtcaagccgctcgcccgggcgttggcgtctggccaggcggtcggcgtgttcggcctccggaaggacacccaggaccaggttcgtgccgggcgcggtcgggggcatgagggccacgaacgccaacacggcctggggggtcatgcttcccatgaggtaccgcgcggccgggtagcacagcagggaggcgatagggtgccggtcgaaaacaagggtgagggccgggggcggggcttgcgggcccacagcctcccccccgatatgaggagccaaaacggcgtccgtcgccgcataaggcgtgctcattgttatctgggcgctggtcattaccaccgccgcctccccggccgatatctcgccgcggtccagacggtgctgcgtgttgtagatgttcgtcagggtctcggaggcccccagcacctgccagtaagtcatcggctcggggacgtagacgatattgtcgcgcggccccagggcctccatcagctgcgcggaggtggtggtcttccccaccccgtggggtccgtctatataaacccgcagcagcgtgggcagctccggatccccgcgggctccggaggccccctggcgatggctaggacgggacgccgcgcggccgtcggtaggcccgctcgcacgagcagcctgaccgaacgcaggcgcgtgctgttggccggcgtgagaagccatacccgcttctacaaggcgttcgcccgagaggtgcgggagttcaacgccaccaggatttgtggaacgctgctgacgctgatgagcgggtcgctgcagggtcgctcgctgttcgaggccacgcgcgtcaccttaatatgcgaagtggacctcgggccgcgccgcccagactgcatctgcgtgttcgaattcgccaatgacaaaacgttgggaggtgtgtgcgtcatcctggagctaaagacatgcaaatcgatttcttccggggacacggccagcaaacgcgaacagcggaccacgggcatgaagcagctgcgccactccctgaagctgctgcagtcgctcgcgcctccgggggacaaggtcgtctacctgtgtcctattttggtgtttgtcgcgcagcgtacgctgcgcgtcagccgcgtgacccggctcgtcccgcaaaagatctccggcaacatcaccgcggccgtgcggatgctccaaagcctgtccacgtatgccgtgccgccggaaccgcagacccggcggtcgcggcgccgggtcgccgcgaccgccagaccgcaaaggcccccctccccgacacgtgacccggaaggcacggcgggtcatccggccccaccagagagcgaccccccctccccaggggtcgtaggcgtcgctgcggagggtgggggtgtgcttcagaaaatcgcggcgcttttttgcgtgccggtggccgccaagagcagaccccggaccaaaaccgagtgaggttctgtgtgttgtttttttttttttttcctcgttttgttttctcttctttcccccccccctcccccgcttctggccaagcatcctcacctgcttaagcggaacccgcgggcgcgcggggactcatttgtcgccggcgacacccacccgacaacagcccctgggtgtcgaccgctgtcgcccccgtctgtcgcctctcccttttttccccccctcaaagaacgtggtgttgggcgccggccaattcttcccggagcgccgtcgtcgcccgcccgccgccctcgaacatggacccgtactaccctttcgacgcgctggacgtttgggaacacaggcgcttcatcgtcgccgactccaggagcttcatcacccccgagttcccccgggacttctggatgttgcccgtgttcaacatcccccgggagacggcggcggagcgggcggcagtgctgcaggcccagcgcaccgcggccgcggcggccctggagaacgccgccctccaggccgccgagctgcccgtcgacatcgagcgccggatacgcccgatcgagcagcaggtgcatcacatcgccgacgccctggaggcgctggagaccgcggcggccgcggccgaagaggcggatgccgcgcgggacgccgaggcgaggggggagggcgctgcggacggggcagcgccgtcgcccaccgcgggccccgccgccgcggagatggaggttcagatcgtacgcaacgacccgccgctacgatacgataccaacctccccgtggatctgctacacatggtgtacgcgggccgcggggccgcgggttcgtcgggagtcgtctttggtacctggtaccgcacgatccaggaacgcaccatcgcggacttccccctgaccacccgcagcgccgactttcgagacgggcgcatgtccaagaccttcatgaccgcgctggtcctgtctctgcagtcgtgcggccggctgtacgtgggccagcgccactattccgccttcgagtgcgccgtgctgtgtctgtatctgctgtaccgaaccacccacgagtcctcccccgatcgcgatcgcgctcccgttgcgttcggggacctgctggcccgcctgccgcgctacctggcgcgtctggccgcggtaatcggcgacgagagcggacgcccgcagtaccgctaccgcgacgacaagctgcccaaagcgcagttcgcggcggccggcggccgctacgagcacggggccctggccacccacgtcgtgatcgccacgttggtgcgccacggggtgctaccggcggccccgggcgacgttccccgagacaccagcacccgcgtgaaccccgacgacgtggcccaccgcgacgacgtcaaccgcgccgccgccgcgtttttggcacgcggccacaacctcttcctgtgggaggaccagacgctgctgcgggcgaccgccaacaccattacggccctggccgtgcttcggcggctcctcgcgaacggcaacgtgtacgcggaccgcctcgacaaccgcctgcagctgggcatgctgatcccgggagccgtcccggcggaggccatcgctcggggggcgtccggattggactcgggcgccataaaaagcggcgacaacaacctggaggcgctgtgcgttaactatgtacttccgctgtatcaggcagaccccacggtcgagctgacccagttgtttccggggctggccgccctgtgcctggacgcccaggcggggcggccactggcgtcgacgaggcgcgtggtggatatgtcgtcgggcgcccgccaggcggcgctcgtgcgcctcaccgcgctggagctcatcaaccgcacccgcacaaacaccacccctgtgggggagattattaacgcccacgatgccttggggatacaatacgaacagggcctggggctgctcgcccagcaggcacgcatcggcttggcgtcaaacaccaagcgattcgccacgttcaacgtgggcagcgactacgacctgttgtactttttgtgtctcgggttcattccccagtacctgtccgtggcctagggaagggtgggggtggtggtggtggggtgtttttctgttgttgtttctggtccgcctggtcacaaaaggcacggcgccccgaaacgcgggctttagtcccggcccggacgtcggcggacacgcaacaacggcgggccccgtgggtgggtaagttggttcgggggcatcgctgtattcccttgcccgcttccacccccccccccttcccgttttgtttgtttgtgcgggtgcccatggcgtcggcggaaatgcgcgagcggttggaggcgcctctgcccgaccgggcggtgcccatctacgtggccgggtttttggccctgtacgacagcggggacccgggcgagctggccctggacccagacacggtgcgtgcggccctgcctccggagaaccccctgccgatcaacgtagaccaccgcgctcggtgcgaggtgggccgggtgctcgccgtggtcaacgaccctcgggggccgttttttgtggggctgatcgcgtgcgtgcagctggagcgcgtcctcgagacggccgccagcgccgctatttttgagcgccgcggacccgcgctctcccgggaggagcgtctgctgtacctgatcaccaactacctgccatcggtctcgctgtccacaaaacgccggggggacgaggttccgcccgaccgcaccctgtttgcgcacgtggccctgtgcgccatcgggcggcgccttggaaccatcgtcacctacgacaccagcctagacgcggccatcgctccgtttcgccacctggacccggcgacgcgcgagggggtgcgacgcgaggccgccgaggccgagctcgcgctggccgggcgcacctgggcccccggcgtggaggcgctcacacacacgctgctctccaccgccgtcaacaacatgatgctgcgtgaccgctggagccttgtggccgagcggcggcggcaggccgggatcgccggacacacgtaccttcaggcgagcgaaaaatttaaaatatggggggcggagtctgcccctgcgccggagcgcgggtataaaaccggcgccccgggtgccatggacacatcccccgccgcgagcgttcccgcgccgcaggtcgccgtccgtgcgcgtcaagtcgcgtcgtcgtcttcttcttcttcttttccggcaccggccgatatgaaccccgtttcggcatcgggcgccccggcccctccgccgcccggcgacgggagttatttgtggatccccgcctctcattacaatcagctcgtcaccgggcaatccgcgccccgccacccgccgctgaccgcgtgcggcctgccggccgcggggacggtggcctacggacaccccggcgccggcccgtccccgcactacccgcctcctcccgcccacccgtacccgggtatgctgttcgcgggccccagtcccctggaggcccagatcgccgcgctggtgggggccatcgccgccgaccgccaggcgggtgggcttccggcggccgccggagaccacgggatccgggggtcggcgaagcgccgccgacacgaggtggagcagccggagtacgactgcggccgtgacgagccggaccgggacttcccgtattacccgggcgaggcccgccccgagccgcgcccggtcgactcccggcgcgccgcgcgccaggcttccgggccccacgaaaccatcacggcgctggtgggggcggtgacgtccctgcagcaggaactggcgcacatgcgcgcgcgtacccacgccccctacgggccgtatccgccggtggggccctaccaccacccccacgcagacacggagacccccgcccaaccaccccgctaccccgccaaggccgtctatctgccgccgccgcacatcgcccccccggggcctcctctatccggggcggtccccccaccctcgtatcccccagttgcggttacccccggtcccgctcccccgctacatcagccctcccccgcacacgcccacccccctccgccgccgccgggacccacgcctccccccgccgcgagcttaccccaacccgaggcgcccggcgcggaggccggcgccttagttaacgccagcagcgcggcccacgtgaacgtggacacggcccgggccgccgatctgtttgtgtcacagatgatggggtcccgctaactcgcctccaggatccggacttggggggggtgtgtgttttcatatattttaaataaacaaacaaccggacaaaagtatacccacttcgtgtgcttgtgtttttgtttgagaggggggggtggagtgggggggaaagtgggccgaatgacacaaaaattaggtcggaggggtgaggggggggggctaggagccgaaccgatggcccccacacgcgacggaaggcccggaagactaccacggggagggggtgtggaaagcgaccggtcgcagggagacggggttggtttggggttggtttggggttggttttcccgttagcacatgtctgcatttgtttttctagtcacacgccccccccccccaaataaaaaccaaggcaaaacaataccagaagtcatgtgtatttttgaacatcggtgtctttttatttatacacaagcccagctcccctcccctcccttagagctcgtcttcgtctccggcctcgtcctcgttgtggagcggagagtacctggctttgttgcgcttgcgcagaaccatgttggtgaccttggagctgagcagggcgctcgtgcccttctttctggccttgtgttccgtgcgctccatggccgacaccaaagccatatatcggatcatttctcgggcctcggccaacttggcctcgtcaaacccgcccccctccgcgccttcctccccctccccgcccacgcccccggggtcggaagtcttgagttccttggtggtgagcggatacagggccttcatgggattgcgttgcagttgcaggacgtagcggaaggcgaagaaggccgcgaccaggccggccaggaccagcagccccacggcaagcgccccgaaggggttggacataaaggaggacacgcccgagacggccgacaccacgccccccactactcccatgactaccttgccgaccgcgcgccccaagtcccccatcccctcgaagaacgcgcacagccccgcgaacatggcggcgttggcgtcggcgcggatgaccgtgtcgatgtcggcaaagcgcaggtcgtgcagctggttgcggcgctggacctccgtgtagtccagcaggccgctgtccttgatctcgtggcgcgtgtagacctccaggggcacaaactcgtggtcctccagcatggtgatgttcaggtcgatgaaggtgctgacggtggtgacgtcggcgcgactcagctggtgagagtacgcgtactcctcgaagtacacgtagcccccgccgaagatgaagtagcgccggtggcccacggtgcacggctcgagcgcgtcgcgggtgaggcgcagctcgttgttctcgcccagctgcccctcgatcagcgggccctggtcttcgtaccgaaagctgaccagggggcggctgtagcacgtccccggccgcgagctgacgcgcatcgagttctgcacgatcacgttgtccggggcgacgggcacgcacgtggagacggccatgacgtctccgagcatgcgcgcgctcacccgccggccgacggtggcggaggcgatggcgttggggttgagcttgcgggcctcgttccagagagtcagctcgtggttctgcagctcgcaccacgcgacggcgatgcgccccagcatgtcgttcacgtggcgctgtatgtggttatacgtaaactgcagccgggcgaactcgatcgaggaggtggtcttgatgcgctccacggacgcgttggcgctgggcgcctcccgcagtggcgcgggcgtggcattccggggcttgcggtcctgctcccgcatgtactcccgcacgtacagctcggcgagcgtgttgctgaggaggggctggtacgcgatgaggaagccccccgtggccaggtagtactgcggctggcccaccttgatgtgcgtggcgttgtacttgcgcgcaaacatgcggtcgatggcctcgcgggcatcccggccgatgcagtcgcccaggtcgacgcgcgagagcgagtactcggtcaggttggtggtgaaggtggtcgagatggcgtcggaggagaagcggaaggagccgccgtactcggcgcggagcatctcgtccacctcctgccacttggtcatggtgcagaccgccggtcgcttcggcacccagtcccaggccacggtaaacttgggggtcgtcagcaagttgcgggtcgtcggcgacgtggcccgggccttcgtggtgaggtcgcgcgcgtagaagccgtcgacctgcttgaagcggtcggcggcgtagctggtgtgctcggtgtgcgacccctcccggtagccgtaaaacggggacatgtacacaaagtcgcccgtcgccagcacaaactcatcgtacgggtacaccgaccgcgcgtccacctcctcgacgatgcagttgaccgtcgtgccgtaccgatggaacgcctccacccgcgaggggttgtacttgaggtcggtggtgtgccacccccggctcgtgcgcgtggcgaccttcgccggcttgagctccatgtcggtctcgtggtcgtcccggtgaaacgcggtggtctccatgttgttccgcacgtacttggccgtggagcggcagacccccttggcgttaatcttgtcgatcacctcctcgaagggaacgggggcgcggtcctcgaatatccccataaactgggagtagcggtggccgaaccacacctgcgacacggtcacgtctttgtagtacatggtggccttgaatttgtacggggcgatgttctccttgaagaccaccgcgatgccctccgtgtagttctgcccctccgggcgcgtcgggcagcggcgcggctgctcaaactgcaccaccgtggcgcccgtcgggggcgggcacacgtaaaactgggcatcggcgttctcgaccttgatttcccgcaggtgcgcgcgcagcgtggcgtggccggcggcgacggtcgcgttggcgtcggggggcggggtcgcctcgggccgcttgggcggctttttggttttccgcttccgggccttggtggtcgcggggctcgggacggggggcggccgggaggcgggacccccgttcgccgcgacggtcgcggccacgccgcccgaggcgcggggggccgccggggccgccggggccgccgacgccaccgcggccaccagcgcccccacgaccagcgcgcaaatcaagccccccccgcgcatggcgggcctacgggggcgcgtcgctcccgccgcccgctagtctgggggcgaggtgctgcaggaccgagtagaggatggaaaaaacgtctcggtcgtaaaccacgaccgagcggggtccgatgcagccgtcggggccgctctcgacgatggccaccagcggacagtcggagttgtacgtgaggtacacgcccggcgggtagcggtacagaccttcggaggtcgggcggctgcagtcggggcggcgcaactcaagctccccgcaccggtagaccgacgcaaagagtgtggtggcgataatgagctcgcgaatatatcgccaggcggcgcgctgggtgggcgtgattccggaaacaccgtcaaaacagtagaacttttgaaactcgctgacggcccaatcagcgcccgaaccccccgcgcccatgatgaagcgggcgagttcctccttgaggtgcggcaggagccccacgttctcgacgctgtagtacagcgcggtgttggggggctgggcgaagctgtgggtggagtggtcgaacaggggcccgttgacgagctcgaagaagcgatgggtgatgctggggagcagggccgggtccacctggtggcgcagcagcgacgctcgcatgaaccggtgcgcgtcaaacacgcccggggcggcgcggttgtcgatgaccgtgcccgcgcccgccgtcagggcgcagaagcgcgcgcgcgccgcgaagccgttggcgaccgcggcgaaggtcgcgggcagcacctcgccgtggacgctgacccgcagcatcttctcgagctccccgcgctgctcgcgcacgcagcgcccgaggctggccagcgaccgcttggtcaggcggtccgcgtacagccgccggcgctcccgcacgtccgcggcggcccgcgtcgcgatgtcgccccagctctccggcccctgcgcccctggctcggggccgcgctccccgtcctcgctcgcgggcgtccccgcgccacgcctccgccccccctcctccgcggcggcccggggctcttcctcctcggcccccccggtcgcgccgccggcccccagccgcgccagcacgcggcgcagcgcctcctcgtcgcactgctcggggctgacgagccgccgcagcagcggcgtcgtcaggtggtggtcgtagcacgcgcgtatcagcgcctcgatctgatcgtcgggcgacgtcgcctggccgccgatgatcagggcgtccaccatgtccagcgccgccaggtggcccccgaacgcgcgatcgaagtgctccgcccgccgcccgaacagcgccagctccacggccaccgcggcggtctcctgctgcagctcgcgctgcgccagcgcgttcaggttgtcggcgaaggcgtccatggtggagtggcgggcgcgatcgccggacgccagccagaagcgcagctcgctgatggcgtacaggccgggcgtagtggcctgaaacacgtcatgcgcctccagcagggcgtcggcctcctcgcggacagaagagctatcggcgggcggcgggccggcccgggccccgccgcccgccgcggtccgcgccagcgcctggtccagcacacagagcgctcgcgcgcgggcggcgtccgacagcccggcggcgtggggcaggtaccgtcgcagctcgttggcgtccagccgcacctgggcctgttgggtgacgtggttacagatgcggtccgccaggcggcgggcgatggtcgccccctggttcgcggtgacgcacagctcctcgaaacagaccgcgcacgggtgggacgggtcgctcagctccgggggcacgatgaggcccgaccccaccgccgccaccataaactcccggacgcgctccagcgcggccgtggcgccgctcgggggggtgatgaggtggcagtagttcagctgcttgagaaaattctcgacatcatgcaggaagcacagctccatgcggacgtccccgccgtacgtctgcagccggatctgctggtggtacggacagggtcgggccagacccatggtctcggtgaaaaaggcagagacgtcacccgtggtcgcgaacgtttccaggtggcccaggagccgctccccctcgcgccacgcgtactccaggagcaactccagggtgaccgacagcggggtgagaaaggcggcggcctgagcctccagccccggccgcaggtgccgccgcagcacgcgcacctggagcgcgttgagctttagctgggcgagcttccccaggccgatctgggggtcgcatcgtcgaagcagctctagctgaaaaacgtacgtctgtacctgcccgagcagggccaacagtttctgtcgggccgcagtgggctcggaaaccgcggccgggggcgcggccgccatggcgagtcacccggccgtgctgtggtttagttaaggtttgggggggggtgggtcagaggcgcgccccgcgcggactgatgcggcggcgggcccctgacatcccctctttatgcccgtcgcccgcccgcccgccccgccggtgtgccgtgattcgcggagtcggggccttgtgtttctttctttcccccccgaatccgttctttcttcctcacccccccctccccacacacccacccaggactcgccaccacaaggaggcgagagcccgtcgctaacccaaagacacagtcacgagacacgatatcgactgtagttgcgatcgtttattttatacacaacaccaacctttccttcgaccccccccacccccgcccctagagcatatccaacgtcaggtcctttttctccggtggtccctccccaaacggatcgtcgccgtgaaacgcccgctttcgggcgacgccggccgcccccgccgccgccgccaaaccgccgaacgacgccgcgtggtcatcctcgtcgccgaaatccccaaagttaaacacctccccggcggcgccgagctggctgaccagggcctccgcctcgtgggccacctccagggccgcgtcggtcgaccactcgccgtgcccgcgctccagggcgcgggtggtaaactccatcatttcctcgctcaggtactcgtcctccagcagcgccagccagtcctcgatctgcagctgctgggtgcgggggcccaggctcttgacggtcgccacaaacacgctgctggcgaccgccgccccgccctccgcaatgatgccccggagctgctcgcacagcgaatgctcgtgggccccgcccccgagactcgacgccgcgcacacaaacccggccctggggcaggccaggacaaacttgcgggtgcggtcaaagatcagcagcgggcacgcgtttttgccgcccagcaggctggcccagttcccggcctgaaacacgcggtcgttgccggccatgccgtagtatttgctgatgctgaggcccagcacgaccatcgggcgcgcggccatcacgggccgcagcaggttgcagctcgcgaacatggacgtccaggcgccggggtgcgcgtcgagggagtccatcagcgcgcgggccccggcctccaggcccgcgccgccctgcggggcccaggcggccgccgcctgcacgctggggggacggcgggacccggcgatgacggccgtgagggtgtttatgaagtacgtcgagtggtcgcagtacctcaagatctggttggccatgtagtacatggccagttcgctcacgttattgggggccaggttgataaagttaatcgcgccgtagtccagggagaacctcttaatgaacgcgatggtctctatgtcctcgcgcgacaagagccgggcggggagctggttgcgctggagggcggtccagaaccactgcgggttcggctggttcgaccccgggggcttgccgttgggaaagatgaccgcgtggaactgcttcagcaggaagcccagcggtccgaggaggatgtccacgcgcttgtcgggcttctggtaggcgctctggaggctggcgacccgcgccttggcggcctcggacgcgttggcgctcgcgcccgcgaacaacacgcggctcttgacgcgcagttccttgggaaacccaagggtcacgcgggcaacgtcgccctcgaagctgctctcggcgggggccgtctggccggccgttaggctgggggcgcagatagccgccccctccgagagcgcgaccgtcagcgtcttcgccgacaggaacccgttgttgaacaggtccatgacgcgccgccgcagcaccggttggaattgattgcgaaagttgcgcccctcgaccgactgcccggcgaacaccccgtggcactggctcagggccaggtcctggtacacggcgaggttggaccgccgcgcgaggagctgcagcagggggcacggcccgcaggtgtacgggtccagcgacagcgacatggcgtggttggcctcggccagaccgtcgcggaacttaaagttgcgcccctcgatcaggttgcgcatcagctgttccacctcgcgatccaccagctgcttgatgttgttcaccaccgtgtgcagggcctcgcggttgccgataatcgtctccagcctccccagggccgtgggcaccgcctggtccacgtactgcagggcctcgagctcggccatgacgcgctcggtggccgcgcggtacgtctcctgcatgatggtccgggtgttctcggacccgtccgcgcgcttcagggccgagaaggcggcgtagttccccagcacgtcgcagtcgctgtacgcgctgttcatcgttccgaagaccccaatggccccccgggcggcgctcgcgaacttggggtggcgggcccgcagccgcatcagcgtcgtgtgcgcgcaggcgtggcgggtctcgaaggtacacaggttgcagggcacgtcggtctggcccgagtccgcgacgtagcgaaacacgtccatctcctggcgcccgacgatgactccgccgtcgcagcgctccaggtaaaacagcatcttggccagcagggccggagagaacccgcacagcatggccaggtgctcgccggcgaactcctgggttccgccgacgaggggcgccgtggggcgcccctcgtacccgggcaccacgtggccctcgcggtccagctgcgggttggccgccacgtgcgtgccgggcacgagaaagaagcggtaaaaggagggcttgctgtggtccttggggtccgccggcccggcgtcgtccacctcggtcaggtggagggccgaattggtgctgaacaccatggcgcccacgaggcccgcggcgcgcgccaggtacgccccgacggcgccggcgcgggccgcgggcgtttcctggccctcaagcaggggccacgtggtgatgtcggggggcggctcgtcaaagaccgccatcgacacgatggactccagggccagggcggcgtcgcccgccatcaccgaggccaggcgctgctcaaacccgcccgccgggcccttgttcccggcgtcgcgcgcgccccgctggggcttaccctggctggcctcgaaggccgtgaacgtaatgtcggcggggagggccgcgccctcgtggttttcgtcgaacgccaggtgggcggccgcgcgggccacggcgtccacgttccgggcacgcagggccacggcggcgggcccgacgaccgcctcgaacagcaggcgggcgagggggcggttgaaaaacggaagggggtagttgaaattctccccgatcgatcggtggttgcagttaaacggatcggcgatgacccggctaaaatccggcataaacatctgcagcggatacacggggatgcggtgaacctccgcgtccccgatggttaccttgtccatcccgcccagatgcaggaaggtgttgctgatgcacacggcctcccggaagccctccgtgatcaccagatacagcaaggcccggtccgggtccagtccgagccgctcgcacagcgcgtcccccgtcgtctcgtgctttaggtcgcagggccggggcgcgtagtccgcgaagccaaaatggcggcgcgcccgctcgcagagccgcgtcaggttgggggcctgggtgctgggggccaggtggcggccgccgtgaaagacgtaaacggacgggctgtagtgcgagggcataagcttgagggacaccgcggtccccccaaggcccgtcgtgcgggacccgacgaccgcggccacgttggcctcaaacccgctctccacggtcaggccgacgatgaggggcgcgacggcgacgtccgcgtcgccgctgcgcgccgacagtagcgacagcagctccaggccttcggccggacaggcgcggccatacacgtaccccatcggccccggaggaaccttgacggtggtcgtcgttttgggcttggtgtccatggctttcgggagatcggcgaccggcaggaacgggggcccggcaagacgaccgggggcagacgggggaggccgcgcgtggtcgacggctgctgcccgccgtcgtctctccgatggggtcgaatgccggcgctgggggtggggtctacacccgcccgttcgccgagcggcccctggtgggggtgggatgggtgggatggggtgggcgagaatggcccgccaccggatcgcgccggacgggggggcccggggttgggcaaggtttgggcgcaaggctccagcggcgattcgagaggcctgcggatggcggcccagagctgggtatgctcggccggggcggccggtatatgtacggcgtgctgggaggggcggcgtcgggccccgcccacggtccgccacgccccgcgcgtcatcggcagggggcgtggccgcccttctaaaaaaagtgagaacgcgaagcgttcgcactttgtcctaataatatatatactattaggacaaagtgcgaacgcttcgcgttctcactttttttagaagggcggccacgccccctttgacgtcacgctcacccgggcggccggccgcccataagcgcggcctgccgggccgataaaaagaaaccgcggcgcccccgcggacaccacacactggctctcgaaccccggacgcgcagaagggacccgggcgcgggtccgccggtaagagccggggggaacatcggcaccgccatcccaccccgagctgttgggtgggcgggtgggggggctggtgaggcggtggtgggagggggcggcgtatagcaggacaacgaccggcggcgatgttttgtgccgcgggcggcccggcttcccccggggggaagccggcggctcgggcggcgtctgggttttttgccccccacaacccccggggagccacccagacggcaccgccgccttgccgccggcagaacttctacaacccccacctcgctcagaccggaacgcagccaaaggccctcgggccggctcagcgccatacgtactacagcgagtgcgacgaatttcgatttatcgccccgcgttcgctggacgaggacgcccccgcggagcagcgcaccggggtccacgacggccgcctccggcgcgcccctaaggtgtactgcgggggggacgagcgcgacgtcctccgcgtgggcccggagggcttctggccgcgtcgcttgcgcctgtggggcggtgcggaccatgcccccgaggggttcgaccccaccgtcaccgtcttccacgtgtacgacatcctggagcacgtggaacacgcgtacagcatgcgcgccgcccagctccacgagcgatttatggacgccatcacgcccgccgggaccgtcatcacgcttctgggtctgacccccgaaggccatcgcgtcgccgttcacgtctacggcacgcggcagtacttttacatgaacaaggcggaggtggatcggcacctgcagtgccgtgccccgcgcgatctctgcgagcgcctggcggcggccctgcgcgagtcgccgggggcgtcgttccgcggcatctccgcggaccacttcgaggcggaggtggtggagcgcgccgacgtgtactattacgaaacgcgcccgaccctgtactaccgcgtcttcgtgcgaagcgggcgcgcgctggcctacctgtgcgacaacttttgccccgcgatcaggaagtacgaggggggcgtcgacgccaccacccggtttatcctggacaacccggggtttgtcaccttcggctggtaccgcctcaagcccggccgcgggaacgcgccggcccaaccgcgccccccgacggcgttcggaacctcgagcgacgtcgagtttaactgcacggcggacaacctggccgtcgagggggccatgtgtgacctgccggcctacaagctcatgtgcttcgatatcgaatgcaaggccgggggggaggacgagctggcctttccggtcgcggaacgcccggaagacctcgtcatccagatctcctgtctgctctacgacctgtccaccaccgccctcgagcacatcctcctgttttcgctcggatcctgcgacctccccgagtcccacctcagcgatctcgcctccaggggcctgccggcccccgtcgtcctggagtttgacagcgaattcgagatgctgctggccttcatgaccttcgtcaagcagtacggccccgagttcgtgaccgggtacaacatcatcaacttcgactggcccttcgtcctgaccaagctgacggagatctacaaggtcccgctcgacgggtacgggcgcatgaacggccggggtgtgttccgcgtgtgggacatcggccagagccactttcagaagcgcagcaagatcaaggtgaacgggatggtgaacatcgacatgtacggcatcatcaccgacaaggtcaaactctccagctacaagctgaacgccgtcgccgaggccgtcttgaaggacaagaagaaggatctgagctaccgcgacatccccgcctactacgcctccgggcccgcgcagcgcggggtgatcggcgagtattgtgtgcaggactcgctgctggtcgggcagctgttcttcaagtttctgccgcacctggagctttccgccgtcgcgcgcctggcgggcatcaacatcacccgcaccatctacgacggccagcagatccgcgtcttcacgtgcctcctgcgccttgcgggccagaagggcttcatcctgccggacacccaggggcggtttcggggcctcgacaaggaggcgcccaagcgcccggccgtgcctcggggggaaggggagcggccgggggacgggaacggggacgaggataaggacgacgacgaggacggggacgaggacggggacgagcgcgaggaggtcgcgcgcgagaccgggggccggcacgttgggtaccagggggcccgggtcctcgaccccacctccgggtttcacgtcgaccccgtggtggtgtttgactttgccagcctgtaccccagcatcatccaggcccacaacctgtgcttcagtacgctctccctgcggcccgaggccgtcgcgcacctggaggcggaccgggactacctggagatcgaggtggggggccgacggctgttcttcgtgaaggcccacgtacgcgagagcctgctgagcatcctgctgcgcgactggctggccatgcgaaagcagatccgctcgcggatcccccagagcacccccgaggaggccgtcctcctcgacaagcaacaggccgccatcaaggtggtgtgcaactcggtgtacgggttcaccggggtgcagcacggtcttctgccctgcctgcacgtggccgccaccgtgacgaccatcggccgcgagatgctcctcgcgacgcgcgcgtacgtgcacgcgcgctgggcggagttcgatcagctgctggccgactttccggaggcggccggcatgcgcgcccccggtccgtactccatgcgcatcatctacggggacacggactccattttcgttttgtgccgcggcctcacggccgcgggcctggtggccatgggcgacaagatggcgagccacatctcgcgcgcgctgttcctccccccgatcaagctcgagtgcgaaaaaacgttcaccaagctgctgctcatcgccaagaaaaagtacatcggcgtcatctgcgggggcaagatgctcatcaagggcgtggatctggtgcgcaaaaacaactgcgcgtttatcaaccgcacctccagggccctggtcgacctgctgttttacgacgataccgtatccggagcggccgccgcgttagccgagcgccccgcagaggagtggctggcgcgacccctgcccgagggactgcaggcgttcggggccgtcctcgtagacgcccatcggcgcatcaccgacccggagagggacatccaggactttgtcctcaccgccgaactgagcagacacccgcgcgcgtacaccaacaagcgcctggcccacctgacggtgtattacaagctcatggcccgccgcgcgcaggtcccgtccatcaaggaccggatcccgtacgtgatcgtggcccagacccgcgaggtagaggagacggtcgcgcggctggccgccctccgcgagctagacgccgccgccccaggggacgagcccgcccccccagcggccctgccctccccggccaagcgcccccgggagacgccgtcgcatgccgaccccccgggaggcgcgtccaagccccgcaagctgctggtgtccgagctggcggaggatcccgggtacgccatcgcccggggcgttccgctcaacacggactattacttctcgcacctgctgggggcggcctgcgtgacgttcaaggccctgtttggaaataacgccaagatcaccgagagtctgttaaagaggtttattcccgagacgtggcaccccccggacgacgtggccgcgcggctcagggccgcggggttcgggccggcgggggccggcgctacggcggaggaaactcgtcgaatgttgcatagagcctttgatactctagcatgagccccccgtcgaagctgatgtcccgcatcttgcaataaatgtctgcggccgacacggtcggaatttccgcgtccgctggtttctctgcgttgcgtctgaccacgagcacaaacgtgctctgccacacgtgggcggcgaaccggtagccggggcacgcggtcagcatccgatcgatgagccggtagtgcaggtgggccgacgtgccggggaagatgacgtacagcatgtggcccccgtacgtggggtccgggtaaaaaagaaaccgggggtcgcacgccccccctccgcgcaggatcgtgtgcacgaaaaagagctcgggctggccgagcgtatcggccaggaggtcctggaggggggtgctgtggcggtcggccagcacgaccagggaggccagaaaggtgcggtgctcaaagatcgtattgatctgctgcacgaaggccaggatgagggcctcgcggctgacggtggccagccgcccgtcgcccgcgctgcacgcggggcagcagcccccgatccccaggtagtagcccatgcccgagagggtcaggcagttgtcggccacggtctggtccaggctgaaggggagcgacacgggggtcgtcttcaccaggggcacggagagcgagcgcacgatggcgatctcctcggagggcgtctgggcgagggcggcgaagaagccgcggtagcgacggcgctcgtgcaggcagagctccagcctgcgcgcgtgcgacggcaggctcttgcgggaggcccggcgctccacgccggggttcccggcggcggaaaagcgcgaccgccgccgggtcttgtcgcggccgggcccgggccgggagccggagcgacggggggcgatgtcatacataggtacagagggtgtgctccagggacaggagagagatcgagtgtcgtctgagcagcgcgccggcctcgcggacaaatgtggccagcgcggtgggcttcggcacaaatacctggtacgtcttgaaggtgtagatgagggcccgcagggctatacagacccgcccctcgaactcgttgccgcaggccaacttggccttgtgaagctgcagctcgtcgcgatggtcggcgcgggggtggccaaacaggacccaggggtcgacttccatctccgtgatggcgcacatcggatcgcagaacatgtgcttgaagatggcctcggggcccgcggcccgaagcaggctcacgaaccggcccccgtccccgggctgcgcctcggggtccgcctcgagctggtccacgaccggcactatgcagtcgaagaggctggtgttgttctccgagtagcggacgacggacgccctcaggcgtcgcatggccagccagtaggcccgcaccagcaacagattgcacagcaggcattccccgccggtgcgcccgcggccccggccgtgcttcagcacggtggccatcagcgggcccaggtccaggtcgggctgggcctggggctcggcgaactgcgcaaaacgcggggccgcgtcgcgcatgcgcgccccgcggtgcgcttcccaggactcgctgaccgcggcgcggcgggcgtccgcggcggcgcgcagccggggccccgactcccagacggcgggggtgccggcgagcagcagcaggatcaggtcggcgtacgcccacgtctccggctcacccccctgcgccagcgccccggcggcggcctcgaactccccgttgcgggcggcggcgcgcgtgcagcagctgtctccgcccccgcgcttgccctcggtgcagtcgagcaggcgggcgcagtccttccagttcatcagggcggtggtgagggagggttgcgttcccgagcccccgcccgcccccgcccccgccccgtcatcgcccccggaggccagggtcccgatgagggcccgggttgcggactgcgcgaggaaggaatagttggagtactgcaccttggcggcgcccggggagggcgtcggcctgggttgcttctgggcgtggcgcccgggcaccccgccgtcggtccggaagcagcagtggagaaagaaatgccggtggatgtcgttgatggtcagggcgaagcgcgcgaaggagccgacaagggtcgccttcttggtgcgcaggaagtggtggtccatgacgtagacgaactcgaaggcggccacgaagatgctcgcggcgcagtggggcgcgcccaggcacttggcgcagaggaacgcgtaatcggccacccactggggcgagaggcggtaggcctgcttgtacagctcgatggtgcggcagaccagacaggggcggtccagcgcgaaggtgtcgacggacgccgcggcgaagggccccgtgtccaagagtccctctgccgtggggtctgcgggcgggccgcgggcggaccccggcccccgcccccccgaagcctcgcgcgcggccccgcgcggccgcgggggggcgggcgcgacgtcgctctccacgtcctcgtcgagcgcgctcgcgggcggcacgcctaccacgtgacaggccgccaggagctcggcgcacagggcctcgttaagagccagaaggtcgggatcgaaggccacatacggacgctcgaacgcgccctccttccagctgctgcccggcgactcttcgcgcacggcggcgctcgacggcacccccggggcggacgtcgccatggccggtcgagcggggcgcacgcgtccgcgaacgttacgggacgcgatccccgactgcgcgctgcggtcccagaccctggaaagtctagacgcgcgctacgtctcgcgagacggcgcgggggacgcggccgtctggttcgaggacatgacccccgccgaactagaggttatattcccgaccacggacgccaagctgaactacctctcgcggacgcagcggctggcctccctcctgacgtacgccgggcctataaaagcgcccgacggccccgccgccccacatacgcaggacaccgcgtgcgtgcacggcgagctgctcgcccgaaagcgcgaacggttcgcggcggtcattaaccggttcctggacctgcaccagatcctgcggggctgacgcgcgcttcggcggggcaccggcaccgggaccgacttgttttacataacagtagggggtgggggaacgcgcacccttgcccggtcgcgatggcggggatggggaagccctacggcggccgcccgggggacgcgttcgagggtctcgttcagcgcatcaggctcattgttcccgccacgctgcgcggcgggggtggggagtcgggcccctactcgccatccaacccgccctcgagatgtgccttccagttccacggccaggatgggtccgacgaggccttcccgatcgagtacgtcctgcggctcatgaacgactgggccgatgtgccctgcaacccctacctgcgcgtgcagaacaccggcgtttcggtgctgtttcaggggttttttaaccggccccacggcgccccggggggcgcgatcacggcggagcagaccaacgtgattctgcactccaccgagacgacgggactgtccctcggagacctggacgacgtcaaggggcgcctcggcctggacgcccggccgatgatggccagcatgtggatcagctgctttgtgcgcatgccccgggtgcagctcgcgtttcggttcatgggccccgaggacgccgttcgcacgcggcggatcctgtgtcgcgccgccgagcaggccctcgcccgtcgccgccggtccaggcggtcccaggatgactacggggcggtggtggtggcggcggcgcaccactcttccggagcgcccgggccgggggtcgccgcctcgggcccgccagcgccgcccggacggggaccggcccgtccgtggcatcaggccgtgcagttgttccgggccccgcgtccgggccccccggcgcttctgttgctggcggcggggctgtttctgggggccgctatctggtgggcggttggcgcgcgcctatgaaagggggcgagccaccgtcccgcccgccagtgcatcccagacgcccgcgagccgcacatcccctccgctcccgcctccggcccgattcttacggcgcgacccaaggtcccgatggccgccccgcagtttcaccgccccagcaccattaccgccgacaacgtccgggcgctcggcatgcgcgggctcgtgttggccaccaacaacgctcagttcatcatggataacagctacccgcatccgcacggaacgcagggtgcggtgcgagagtttcttcgcgggcaggccgcggcgctgacggacctcggggtgacccacgccaacaacacgttcgccccgcagcctatgttcgcgggcgacgccgcggccgaatggctgcggccctcgttcggtcttaagcgcacgtattccccctttgtcgttcgcgaccccaagacccccagcaccccgtgagtcctcggcgggtccctccgcggccgtctctcgttgcccccctttcccccttcccgggtggttcaataaaaaacaccaacatacgatattcgcgtttgatacgtttattggggggggtgtagggcccaacgatcggcgattaacaacaccaaacaatcgagcgcgtctaacccagtaacatgcgcacgtgatgtaggctggtcagcacggcgttgctgcgctgaaacagcgccctgcgggtccgctgcagctgttgttgtatgcggcggcatgcgcggatcaaaaccgccagggcgctacgaccggtgcttcgtacgtagcgtcgcgacaagacggcatttgcctgtacgggcaaggggccaaattgcgagtgtggtgactggaggtggtcggcggccaatgggccgggtggttcgtcggcggggggcaagtgcggttccggtgggagggggtcgagcgcctcggtatcatccgagtccgagaaacgcagggagtctgcgtcggagtgttcatcatcggaggagatgtgcagcgtctgaagcagcgatgcgggtgggggcgcggagtcgacgtgaagcgcgagagaggaagcccacgaagtcacagcggacactgggaggtgggtgtttgtatgtgtgggagactcgggcgtcgggaccgagtctcggctctggggtgtaagcgtccgagttacgggcggcaggggcggctggggcaggggcggctggggcaggggcggctggggcaggggcggctggggcaggggcggctggggcaggggcggctggggcaggggcggctggggcaggggcggctggggcaggggcggctggggcaggggcggctggggcaggggcggctggggcaccgagcgcgcgcggatgcgcgtccgcgcggcgggtttggtcgcgggtgactggggtggggggcggcgggcaaccgggcctccgggcacgacccaaccgcacaaaggctcgctcggggcaaccgggcctggggccaaaggcggggggctggtctggacggcggaggtcgggggggcaaggcccggagaaggcggcactgccgccgctgcggcggaaaccgcggccgcgtggtcggctgggtcccggggagaggggagggagttcaacgaggccgagagcgaggcgaccgcggggcgcgtgaggcgccggggtgggccggccgcggggccccgggggggtgtcggcgagggacccgctgttgtctggcggcggccgcggcggcggtcgcccccggggacgaccgctccttcggcgggcggaggcgggatgggcgcgagcgtgggggcgggaaaggccccgcgagccgaggcggggccgggcggaaggggcaaagcagaaacccaagccgggggcgcggactccggggtgggcggctggtcgggaggacgcgcggaagcggcgaccggggcgaccggggcggggagtgccggcggacgccacccctcggggggggcggaggcccggggcgcgcgcgatttggcacgcgtccggcgggacctgcgcacgcgcggcacggcggcggagaaagcggcggcagagccggaaaaggccgggggaggaagcgcggcatccgcggggggactcggtgtgggtggcgagggccgtgggtcgtcgcgaggggccacgggcacgcgccccgtgttttgttgaggcgggacactcggtcgtgtttcgcgagccgtagctgccggcccgatgggccgcggtgcgtactgggacgtggggacggactgatcggtggcgggggggggaagaagggccggggccggattgggcgtggggccgccggcgtcgtcggacgccagctcctccaggccgtggatccaggcccacatgcgaggggggacgggctcgccggtggtggcgtcggtgaggagagtgggggcgaggacccccgggtccgcctgccgtgcggggggggcagcggggtcctcgggacccgatccgccatccccccccgcaaggtcccgcgggtcgcgggcggcggtcggggcagagggacctgcctcgtcggcgagggggcgctggtaaaccgggtgtcccgggaacagctcccccgtcaggagggaggcgtcgaagggccgcccgaggatggcccgcgcgaagaaggggtccgcgtcggcggcgctcgccgcgagaacgtcccccgcggtagccacaaacggaagctcctcggtggcctcgctgcccacaaaccgcacgtcaggggggccggggggctccggggcttcccacaagaccgcgaccggggtcatggagatgtccacgaggaccaggcacgggggcccgtcggcgagagggcgctcggcgatgagcgccgacaggcgcgggagctgcgccgccagacacgcgttttcgatcgggttgagatcggtgtggaggaggccgacggcccacgtctcgatgtcggacgacacgacgtcgcgcagggcggcgtccggcccgccggggcgcgagtcgaagagcgtcaggcacagttccagttccgactcgcgggagaaggccgtggtgttgcggagcgccaccacgacgggcgcgccgaggagcaccgcggccagaaccaggtccatggccgtaacgcgcgcggcgggggtgcggtgggtcgcggcggccagcacggccacgtgctggcccgtgggtcggtagagggcgtggggggcctcggggagggacgccttgcgcccccccgccgggccgagcgtctggccagactccaggcgtgcggccaggagggcgtcgaagctgtcgtactcggtgtagtcgtcgggaaacatgcaggtccacagcgcggccaaagcggcgctcggcagacacatgcgcccgaggacgctcaccgccgccagggcctgggccggactgagcttcccgagcgccgggacgtcccggcgctgggtcccgagctccaaggccgagcgccagggcgccagcgggtcggtttcggacagcttgccccggcgccagtcggccagccgcgtgccgaacaggaggccccgggtcggggggcctccgtccaaaaacgtcggcaacacgcggatgcgggcgtcgggatgcggggtcaggcgctggacgaacagcatggactccgctgcgtcctcgaacgcgcgttcgagggtgaggtgcatgtactcgtgctggcgaacgaggtccaggcgccagaagttgtagatgtgttccggaacgccggccaccagcgcgaccagcacgtcgttctcgttgaaggcgacgcagtggcgctgggacccccgggggcccggcggcggacgcggcgccgccgctccggacgcccagcccagctgggcccagcgacacccaaactcgcgcgtgagggtggtggcgacgagggcgacgtacagctcggccgccgcgtccatcgaggcgccccacgtcgcctggcgatggcgcacgaagcgaccgaacagctgaaagttggcggcctgggcgtcgctgagggccagctggagccggttcacgacggtcagcacgtacatggccgtgaccgtcggggccgattcgaggacgtccgtcggaagcgggggccgcacgcaggccgcctcgggacgcatcagcagcgcgccgagtttgtcggtgacggccgggaagcatagcgcgtactgcagcggcgttccgtccggggccaaaaagctggtggcgaacggcagatccagagcgctgacggcctcacgcagcaccaggggccccgggtctccgccggcgcgcagatacgcctcgccccggcggcgcagcagctgcgggtcgacctcgtggccctcgggggaagaagaggcccgggcgcgggcgtcgagggcgcgaagatcaacgagcaggggcgcgggcgcggactccgcgcccgcgcccgtctggccgccggccctggcgtacgcgctatataagcccatgcggtattggatgagttcccgcgcgccccggaactcctccaccgcccacggggccaggtccgcggccgccgcgtcgaactccgccagcaggcgccccagggcgtcaaagttcatctcccagggcaccctgcgcaccacctcatcccgcagccgggcgcacagggcggtgtgcttggtgacgcgcgcgcccagctcctccacggcctccgcgcgctcggcgcccttggcgcccaggacgccctggtacctggcggaaaggcgctcgtaggccggctgggcccgcagccccgacaccgtgttggtggtgtcctgcagggcgcgcagctgctcgtgcatggcgcggaacccctcgggggacttccaggcgcccccccggacgcggccaaagcgaccccagacctcgtcccactccgcctcggcctcctccagggacctccgcagggcgtcgacgcggcgccgagtatcaaagagcgcccccaggcggccggcgtgccgcgccagggggccggggccgtcgccgcgggcggcgcttagcgggtgcgtctcgaaggtgcgctgggcgtgctctagccagataaccgcgggcacgtcgagctcgcgcgttttctcggtctgatccaacagaacctcgacctggtcggcgatctccgccaccgagcgcgcctggtcgagcgtcttggccacggtcgccgggacggcgaccaccttcagcatggtcttgaggttggccaggccctcggcctcgatctgggcccggcgctcgcgcgcggccagcgcctcccgcaggcccgccatgacccgctcggtggcctccgcgcgctgctgtttggcgcgcaccactgcgtccttggtctcggccgtgtcctgccgggtcacgaaggcgacatactcggcgtacgccgtgttcttcacggggctctggtccacgcgctccaacgccgccgcgcacgcgaccagcgcgtcctcgctgggacacggcagggtgaccccggtccggaccagctccgcggtggcctccgggtcattccgggccgcggatatctgctccgcggcggccgccaggtccaggggcacgccgccgagcgcccggtgcacgtcggcccggatggcgtccaggcgatcgcggagctccacgtagtcggcgtagccatgttggaagaacggcacgtaccggcgcaggccgggcacgctcgtcatgtcgtccgccaggcgccccacggcctcgtggtagtcgataaacccgtcgcccgcctgggccatttccaggagcccctccgcgatgcgcagcagccgcgccaggggctcggcgtcgacccgaaacatgtcggcgtaggtttcggcggcggcgtggaacgccgcgctccagccgaggcggtggatggcggcgagcggggggagcatggggtggcgctggttctcgggggtgtaggggttaaacgcgaaggccgtatccagggcgagggtgaccgcctcggcgttggccgcgagcgcctgctcggcgcgcttgcggaagtcccgggggttgtagccgtgcgtgcccgccagcgcctgcaggcggcgcagctcgaccacgtcgaactcggcgcggttctcgacgcggtccagcgccgcctcgacgccggcggcccagcgctcgctgctgccccgggcgcgctgggccgccatcttcgccgtcaggtcggcgacggcggcctcaagttcgtcggcgcggcgtcgcgtggcgccgatgaccttgcccagctcctgcagggcgcgcccgctgggggaatggtccccggccgtcccttcggcgtgcagcaggcccccgaacccagcctcgtgccccgcgaggctttcccgagcagcggtcgtcgcgcgggccgcggcatcgatgagggcggcatggtccccctccggctgggcgcaggcccggcgcgcctggactaccaggtcggcggccgccgaccccagggtcgtgagctcgtcgatggccccccgcgcctccagggccagccgagtcgcctttacataccccgcggcgctatcggccagcaccgcgaggaaggacaggggcgaggccgggtcgcgggcggccgcgcccagggccgacaccgcgtccgccagggcgccatgcgcccgcacggccgcgtccaccgtcgccgcgggacttgccgtcgcgacggcggcgctcccggcgttgatggcgtttgacacggctttggcgattgtgggggcgtgatcggaaaagaactgcacgaggaccggcgtctcgggggcgtcggcgaacagggtcttcagcaccaccacgaaggcgggatgcaggccggccagagccgtcgcggtatccggggtcgggtgttccagggcctcccggtactgccccagcagcccccacaggtccgcccgcagcgccgccgtgacttccgggggggggccccggacggcatcggccaggtcggtccaccccgcgggcagggaggcccgcagggtcgccagcacggccggacacgcctttagccccacaaagtccgggaggggccgcaggaccccttggagtttgtgcaggaacttctcccgggcgtcgtgggccaccttggcgcgctcccgcgcgtcgttgagcatcgcctccagggcgtgggcgcgctcccgaagccgggagcgcgcctccggagcgagctccgccgtcatcttggccgcctccatggccctcgcctgccgcagcgcgtcttcggccatgcgcgtggcctcgggggacagcccgcccccgtcgacgtacggcgcggggccggtcgccgggacgaaggccgcgtcgctgtccagctgctgcgcgagcgccgcgtcgagggcgtcgaagcgctgcagttcggccagccccgagctgcgccgcgcctgctggtcgttgatgccgtggatgctgcgcgccagctcttccaggggcttgcgttcgatgagcccctgggtcgcggcgtcggtcaggaccgagagccaggccgccaggtcctcgggggcatctagggtctggccccgctggagcaggtcccgcagcaggatggcctgggggctggtggcgagggggggcgggggggggagcgcggcgcgctgagcgacgtcccgcgtgtgttggtcaaaggccggtagcgattccagcaactggaccatgggcacgaccgcggccgaggccacgtgaaaccgacagtcgtggctgtcgctggcctgcagggccttcgcgctgtatacggctccccggtggaagtactccttgaccgcgctctcgatcgcccggcgggcctggatccgcacgtcctccagccgcgcctggatggcctcggggcccagggcgggcgggcacggggccctgccgccggcgcccggggcggcgggcacgggcatcacggtcaggggcccggcgcgctgcgagaccgagtcgaccccgcgggcgagggcgtctaaggcctcgcgcatctcgcgggcctccgcctcgacccgcatctcttcgccccgggcaaactgggccagcgcctggatccgatggagaagcggctccgggtgcgtcggggtggcgggggcgaacagggtgttcgggtgggcgcgcgagcgctccaggagccactctccgaggcgtgcgtacagattggccggcggggcggcgcgcagctgcagatccaggtccgcgaggtccccgtaaaaggcgtccgtctcccgaataacgtccctggcgaccaggaccagcttagcgagggccaggcgcccgatctgcgaattttcgtccagcacgtgctggatgaggggccggtgggcggccacgtccgccaggctcatgcgcgtggacgccaggaagtccccgacggccgttttgcggggcagcatgcgcagggtgaagtccagcagggccgcggccgggccggccaccccggcctgcgtatgcgtgcgggccccgttctcgatcaaaaaggcgaggacgcgctcaaagaagaagatgacgcagagctccaacagccccgggtgcgccgggtacggcgaccgcagggcgttgatggtgagctgcgaacacgcggccacctcgcgggccagggcggcatcgcgcgccgcgagccggaccgccgtggcggccacattggggtggacctcgaacagctgcgccaggtcggcgccggggggctccggggggcggcgggcccccagcgtctcgagcacggacggcgacgacgggctcgcgggcccgtcgtcgccgccgccctgcccggactgcgggggggtatccggtgcgggagggaccgtggcggctatgggcgtcggggaggaggcggggacctcggcggcgacgggggccttcttcttgggcgcggacttcttcttggccttggcgggcggggccttgggggcgggcctctcgcccgaggtcagatcctccacgctggacggtggggtccaggtgggccggcggcgcttgggcaagccggtagaatagcgcgcccggtggcgacccaccggcactgcccccacctccaggacccgcaggtcctcggcttcttcggccgcgtccccggcgggtgtctgcgggggcggggcggcgtgcggtggacccgaggccgcggcgtccggggccgagggcttcgcgggcggggtcccctccagggctgctgcccacacatcatcgggggggcggtttgggtgccccgcctgcggtgtgtcgggtgggcccgaggccccccggggggcctcggggggccggtcggccccaggggtctggacgtgggtgggcgcggggagcgcggggacgaccgggcccgagccttctccgtcccccctggggaccacaccgacaaagagcgccccgagccccccgatctcgccccgcagggggtgggtgatggccacgcgccgctcgacgaacggttcgtcctgcaggtaagtctcgctggccccgtagaggtgcagggccgcggcggtcaggtccgccggcgccacggcccccgggccggagggcacaaaaaacaccatggcgcccgcccaccgcaccttggggcggtcgtgggcgtaatacgtcaggtacgggtacacgtcgcccgcccgcaccttggcgataaacgcgggcgttcccgcgggcaggccgtgcgggtcaaacagataggccgtgtcgccgtcccggtagagccccatgcccagggggccgatggtcaggagcgtgtaggacagcggccgcatggcccaggggccggcgaagaacgtgtgcgcggggcattgcgtctccagcagccccgccgtgggctccccgaagaagcccacctcgccgtacacccgcgaaaacacgcaacgcaggccgccgcgcgccgccgggtactccaggaagttggggagctcgataatggaacacatgcgcggcggcccggagcccgcggccgcgcgcgtccactcgcccccctccaccagacatccctcgatggcctccgcggacagcacgtcgcggggccccacgtcgaaaagaagactgagaaacgacagggacgagcgcatgcacgataccgacccccccggctccagatcggtcgcgaactggttccgaacaccggtgaccacgatatcgcgatccccctggcgcttcatcgtggggtgaggtagcgcggccggaatcatgtgtgccgcgcccgccacgagcggggcctgtttatgggccgggcgtcccgatgagtactgttgtttccgccgcccgaacccccccgcccatcaaccgcctgttcgtccccctaaccacacacccggtatcgcgtgtgtgtggtttcccgggaagacacatcccaccccatgaagttttgccctttttttccgtcccgcactacgccacctttccaccccccccccaaaaaaacaacaaccaactcccagatggatgggtgcgataataaagctttattattgtttaaccaaaggcgagtcctacgggtgtaccggtggtgtctcctgcggcgtcatctcgtcgtcctccacgggggtgttgggccaagggaccgtctcgcggcccgccgggcgcgtcgacggcgcgcgggcctgcgtgtcctgtgggccgggtgtcgtgggttcgggggtgctaccgccggcatcttgggcctccaggtccccgggggcccccgggccggcggaaggccgaaacgccgaggcgcgaaacacgccgtcggtgacctgcaggagctcgtttattaatagccagtccatgctcagcgtagcggccagcccctggggagacaggtccacggagtccggaaccaccgtcggctgacccaggggccccaggctgtagtccccccaggcccccaggtcatgacggttcgtgagcacgacgaggtctgcggccgggctggggggcgcgtcctcggtcgcgtgggccatcacctcctgaatggctgcggtgcgctgatcggccgagctggcgaagggcgccacgaccagcgcgcgctccgtctgcaggcccttccacgtgtcgtggagttcctgaacgaactcggccacccgctcggggcccgtggccgcgcgtgcggcctgatagccggccgagaggcgccgccagcgcgccaggaactgactcatgtaacagaacccggggacctggtcccccgacatcaactttgacgccctggcgtggatgcccgacacgatggccaggaacccgtggatttcccgccgcacgacggccagcacgttaccctcgtgcgagacctgggccgccagctcgtcgcataccccgaggtgcgccgtcgtctcggtgacgacggaccgcagccccgcgagggacgcgaccagcgcgcgcttggcgtcgtgatacatgccgcagtactggctcaccgcgtcgcccatggcctcggggcgccagggccccaggcgctcgtgggcgtctgcgaccacggcgtacaggcggtgcccgtcgctctcgaaccggcactcaaagaaggcggcgagcgtgcgcatgtgcagccgcagcagcacgatcgcgtcctccagctggcggaccagggggtcggcgcgctcggcgagctcctgcagcaccccccgggccgccagggcgtacatgctgatcagcagcaggctgctgcccacctcgggaggctgggggggaggcagctggaccgcgggccgcagctgctcgacggcccccctggcgatcacgtacagctcgcgcagcagctgctcgatgttgtcggccatctgcatcgtgggcccgacgccggcccgggtggccggttcgaggagggtgatcagcgcgcccaattttgtgcggtgcccctcgacggtggggagatagcccaggccgaagtcgcgcgcccaggccagcacccgcagggcaaactcgatggggcggggcaggtaggcagcgttgcacgtggccctcagcgcgtccccgaccaccagggccagcacgtaagggacgaaccccgggtcggcgaggacgttggggtggatgccctccagggccgggaagcggatcttggtggccgcggccaggtgaaccgagggggcgtggctaggcggcccgacggggagcagcgcggacagcggcgtggccggggtggtgggggtcaggtcccagtgggtctggccgtacacgtcgagccagatgagcgccgtctcgcgcaggaggctgggctggccggcgctgaagcggcgctcggccgtctcaaactcccccacgagcgtgcgccgcaggctcgccaggtgttccgtcggcacggccgggcccatgatgcgcgccagcgtctggctgaggacgccgcccgacaggccgaccgcctcacagagccgcccgtgcgtgtgctcgctggcgccctggatccgccggaacgttttcacgtagccggcgtagtgcccgtactcccgcgcgagcccgaacacgttcgcccccgcaagggcaatgcacccaaagagctgctggatctcgctgagcccgtggccggggggcgtccgcgcgggcacccccgccaccaaaaacccctccagggccgatatgtactgggtgcagtgcgcgggcgtgaaccccgcgtcggtaagcgtgttgatcaccacggagggcgagttgctgttctggaccaaagcccacgtctgctgcagcagcgcgaggagccgttgctgggccccggcggagggcggctcccctagctgcagcaggccggtgacggccggacggaagatggccagcgccgacgcactcagaaacggcacgtcggggtcgaagacggccgcgtccgtccgcacgcgcgccatcagcgtccccgggggcgcgcacgccgaccgcgggctgacgcggcttagggcggtcgacacgcgcacctcctcgcgactgcgaaccattttggtggcctcgaggggcgggatcatgatagccgggtcgatctcccgcaccgtgtgctgaaactgggccagcagcggcggcgggaccaccgcgccccgatcgggggtcgtcaggtactcgtccaccagcgccagcgtaaacagggcccgcgtgaggggggtcagggcggcgtcgtcgatgcgctgtaggtgcgccgagaacagcgtcacccaattgctgaccagggccaagaaccggagaccctcttgcacgatcggggacgggaagagcaggctgtacgccggggtggtcaggttggcgccgggttgccccaggggaaccggggacatcttaagcgacatctccccgagggcctccagggaggtccgcgggttcatggccaggcagctctgggtgacggtccgccagcggtcgatccactccacggcacactggcggacgcgcaccggccccagggccgccgtggtgcgcagcccggcggcctccagcgcgtgggtcgtgtcggagccggtgatcgccaggaccgtgtccttgatgacgtccatctcccggaaggccgcctcgggggtctcggggagcgccaccgccatgcggtgcaccagcagcccggggaggttctcggccaagagcgccgtctccggaagcccgtgggcccggtgcaaggcgcacagttgctccaggagcgggtgccagcacgcccgcgcctccgccgggccgaccgccgcgcccgacaacagaaacgccgccgtggcggcgcgcagtttggccgcggacagaaacgccggctcgtccgcgctgcccgccggctcgctcgagggggagggcggccggcggaggttggtcaggctccccaacaggacctgcaacggtccgtttgggggtggagcggacgggggggtcatgccggcgggcgccgggacctggagcgcgctgtccgacatggcgaccggcgtgcgcgctcggcgacgcggcgcggagaccgcgggcccaaacgggaatgactgccgccgccctatacggaggggctaagtatcgcccggggacccttcgaaaccccgggcgtgtcgcaagtacgccgcgaaggcgcggcgtgttatacggcgcgttatgtcccggcattccgttcgtgggttcgggcccgggtgctgtcgggtgggagtgtgtgtgggggggggcggcgcgacggcggcccggaccaagtgtatcgcggccgttccgtggggcggcccaacaggccctttaaacatttgcgtatgcaccggcccagccagtcggacaccggaacccaccagaggcggaagccgccttcgcccgtgagggtgcgtgtgttttctggtggcgtgtttttcctttccgccctcctccctccccacctccaccacccccccccacaactcgcccgttggcgatcggcgggaaaaccatgaaaaccaagccactcccgacagccccgatggcgtgggccgagagtgccgtggaaaccaccaccagcccgcgcgagctcgcgggccacgccccgctccggcgcgtcctgcgcccgcccatcgctcgccgcgacggcccggtgcttttgggggacagggcccccaggaggacggccagtacgatgtggctgctggggatcgaccccgcggagtcgtctccgggaacgcgcgctacccgagacgataccgagcaggccgtggacaagatcctcaggggagcccggcgcgcgggagggctgaccgtccccggcgccccccgctatcacctgacccgccaggtaaccctgacggatctctgccaaccaaacgcggagcgggccggggcgctccttttggccctgcggcaccccaccgacctcccccacctggcccgccatcgggctccgcccggccggcagaccgagcgactggccgaggcctggggccagctcctggaggcctccgccctggggtccgggcgggccgagagcggctgcgcgcgcgcgggccttgtgtcgtttaactttctggtggccgcgtgcgccgccgcctacgatgcgcgcgacgccgccgaggcggtccgggcccacatcacgaccaactacggcgggacgcgggccggggcgcggctggaccggttttccgaatgcctgcgcgccatggtccacacgcacgtgtttccccacgaggtcatgcggtttttcggggggctagtgtcgtgggtcacacaggacgagctggctagcgtcaccgccgtctgcagcggaccccaggaggccacacacaccggccacccgggcaggccccgttcggccgttaccatcccggcctgcgccttcgtggacctggacgccgagctgtgcctggggggccctggggcggcgttcctgtacttggtcttcacctaccgacagtgccgggaccaagagctctgttgcgtgtacgtggtcaagagccagctccccccgcgcggactggaggcggccctcgagcggctgttcgggcgcctccggataaccaacacgattcacggggccgaggacatgacgccccctcccccgaaccgaaacgttgactttccgctcgccgtcctggccgcgagctcgcaatccccgcggtgctcggcgagccaagtcacgaacccccagtttgtcgacaggctgtaccgctggcagccggatctgcgggggcgccctaccgcacgcacctgcacatacgccgccttcgcagagctgggtgtcatgccagacgacagcccccgctgtctgcaccgcaccgagcggtttggggcggtcggcgttccggttgtcatcctggagggcgtggtgtggcgccccggcgggtggcgggcctgcgcgtgatcgtctattgacgacggccgcccaacccgagcgaccttcccctcccacttccccccccctacacaccaactccgccctcgccgtcttggccgtgcgcggccccgtgcgtccgtctcaataaagccaggttaaatccgtgacgtggtgtgtttggcgtgtgtctctgaaatggcggaaaccgacatgcaaatgggattcatggacacgttacacccccctgactcaggagataggcatatcctccttagattgactcagcacacgatcgcaccccacccctgtgtgccggggataaaagccaacgcgggcggtctgggttaccacaacaggtgggtgcttcggggacttgacggtcgccactctcctgcgagccctcacgtcttcgcccaccgattcctgttgcgttcctgtcggccggtgctgtcctgtcgacagattgttggcgactgcccgggtgattcgtcggccggtgcgtcctttcggtcgtaccgcccaccccgcctcccacgggcccgccgctgtttccgttcatcgcgtccgagccaccgtcaccttggttccaatggccaaccgccctgccgcatccgccctcgccggagcgcggtctccgtccgaacgacaggaaccccgggagcccgaggtcgccccccctggcggcgaccacgtgttttgcaggaaagtcagcggcgtgatggtgctttccagcgatccccccggccccgcggcctaccgcattagcgacagcagctttgttcaatgcggctccaactgcagtatgataatcgacggagacgtggcgcgcggtcatttgcgtgacctcgagggcgctacgtccaccggcgccttcgtcgcgatctcaaacgtcgcagccggcggggatggccgaaccgccgtcgtggcgctcggcggaacctcgggcccgtccgcgactacatccgtggggacccagacgtccggggagttcctccacgggaacccaaggacccccgaaccccaaggaccccaggctgtccccccgccccctcctcccccctttccatggggccacgagtgctgcgcccgtcgcgatgccaggggcggcgccgagaaggacgtcggggccgcggagtcatggtcagacggcccgtcgtccgactccgaaacggaggactcggactcctcggacgaggatacgggttcggagacgctgtctcgatcctcttcgatctgggccgcaggggcgactgacgacgatgacagcgactccgactcgcggtcggacgactccgtgcagcccgacgttgtcgttcgtcgcagatggagcgacggccccgcccccgtggcctttcccaagccccggcgccccggcgactcccccggaaaccccggcctgggcgccggcaccgggccgggctccgcgacggacccgcgcgcgtcggccgactccgattccgcggcccacgccgccgcaccccaggcggacgtggcgccggttctggacagccagcccactgtgggaacggaccccggctacccagtccccctagaactcacgcccgagaacgcggaggcggtggcgcggtttctgggggacgccgtcgaccgcgagcccgcgctcatgctggagtacttctgtcggtgcgcccgcgaggagagcaagcgcgtgcccccacgaaccttcggcagcgccccccgcctcacggaggacgactttgggctcctgaactacgcgctcgctgagatgcgacgcctgtgcctggaccttcccccggtcccccccaacgcatacacgccctatcatctgagggagtatgcgacgcggctggttaacgggttcaaacccctggtgcggcggtccgcccgcctgtatcgcatcctgggggttctggtccacctgcgcatccgtacccgggaggcctcctttgaggaatggatgcgctccaaggaggtggacctggacttcgggctgacggaaaggcttcgcgaacacgaggcccagctaatgatcctggcccaggccctgaacccctacgactgtctgatccacagcaccccgaacacgctcgtcgagcgggggctgcagtcggcgctgaagtacgaagagttttacctcaagcgcttcggcgggcactacatggagtccgtcttccagatgtacacccgcatcgccgggtttctggcgtgccgggcgacccgcggcatgcgccacatcgccctggggcgacaggggtcgtggtgggaaatgttcaagttctttttccaccgcctctacgaccaccagatcgtgccgtccacccccgccatgctgaacctcggaacccgcaactactacacgtccagctgctacctggtaaacccccaggccaccactaaccaggccaccctccgggccatcaccggcaacgtgagcgccatcctcgcccgcaacgggggcatcgggctgtgcatgcaggcgttcaacgacgccagccccggcaccgccagcatcatgccggccctgaaggtcctcgactccctggtggcggcgcacaacaaacagagcacgcgccccaccggggcgtgcgtgtacctggaaccctggcacagcgacgttcgggccgtgctcagaatgaagggcgtcctcgccggcgaggaggcccagcgctgcgacaacatcttcagcgccctctggatgccggacctgttcttcaagcgcctgatccgccacctcgacggcgagaaaaacgtcacctggtccctgttcgaccgggacaccagcatgtcgctcgccgactttcacggcgaggagttcgagaagctgtacgagcacctcgaggccatggggttcggcgaaacgatccccatccaggacctggcgtacgccatcgtgcgcagcgcggccaccaccggaagccccttcatcatgtttaaggacgcggtaaaccgccactacatctacgacacgcaaggggcggccatcgccggctccaacctctgcaccgagatcgtccacccggcctccaagcgatccagtggggtctgcaacctgggaagcgtgaatctggcccgatgcgtctccaggcagacgtttgactttgggcggctccgcgacgccgtgcaggcgtgcgtgctgatggtgaacatcatgatcgacagcacgctacaacccacgccccagtgcacccgcggcaacgacaacctgcggtccatgggcattggcatgcagggcctgcacacggcgtgcctgaagatgggcctggatctggagtcggccgagttccgggacctgaacacacacatcgccgaggtgatgctgctcgcggccatgaagaccagtaacgcgctgtgcgttcgcggggcgcgtcccttcagccactttaagcgcagcatgtaccgggccggccgctttcactgggagcgcttttcgaacgccagcccgcggtacgagggcgagtgggagatgctacgccagagcatgatgaaacacggcctgcgcaacagccagttcatcgcgctcatgcccaccgccgcctcggcccagatctcggacgtcagcgagggctttgcccccctgttcaccaacctgttcagcaaggtgaccagggacggcgagacgctgcgccccaacacgctcttgctgaaggaactcgagcgcacgttcggcgggaagcggctcctggacgcgatggacgggctcgaggccaagcagtggtctgtggcccaggccctgccttgcctggaccccgcccaccccctccggcggttcaagacggccttcgactacgaccaggaactgctgatcgacctgtgtgcagaccgcgccccctatgttgatcacagccaatccatgactctgtatgtcacagagaaggcggacgggacgctccccgcctccaccctggtccgccttctcgtccacgcatataagcgcggcctgaagacggggatgtactactgcaaggttcgcaaggcgaccaacagcggggtgttcgccggcgacgacaacatcgtctgcacaagctgcgcgctgtaagcaacagcgctccgatcggggtcaggcgtcgctctcggtcccgcatatcgccatggatcccgccgtctcccccgcgagcaccgaccccctagatacccacgcgtcgggggccggggcggccccgattccggtgtgccccacccccgagcggtacttctacacctcccagtgccccgacatcaaccaccttcgctccctcagcatcctgaaccgctggctggagaccgagctcgtgttcgtgggggacgaggaggacgtctccaagctctccgagggcgagctcggcttctaccgctttctgtttgccttcctgtcggccgcggacgacctggtgacggaaaacctgggcggcctctccggcctcttcgaacagaaggacattcttcactactacgtggagcaggaatgcatcgaggtcgtccactcgcgcgtctacaacatcatccagctggtgctctttcacaacaacgaccaggcgcgccgcgcctatgtggcccgcaccatcaaccacccggccattcgcgtcaaggtggactggctggaggcgcgggtgcgggaatgcgactcgatcccggagaagttcatcctcatgatcctcatcgagggcgtcttttttgccgcctcgttcgccgccatcgcgtacctgcgcaccaacaacctcctgcgggtcacctgccagtcgaacgacctcatcagccgcgacgaggccgtgcatacgacagcctcgtgctacatctacaacaactacctcgggggccacgccaagcccgaggcggcgcgcgtgtaccggctgtttcgggaggcggtggatatcgagatcgggttcatccgatcccaggccccgacggacagctctatcctgagtccgggggccctggcggccatcgagaactacgtgcgattcagcgcggatcgcctgctgggcctgatccatatgcagcccctgtattccgcccccgcccccgacgccagctttcccctcagcctcatgtccaccgacaaacacaccaacttcttcgagtgccgcagcacctcgtacgccggggccgtcgtcaacgatctgtgagggtctgggcgcccttgtagcgatgtctaaccgaaataaaggggtcgaaacggactgttgggtctccggtgtgattattacgcaggggaggggggtggcggctggggaaagggaaggaacgcccgaaaccagagaaaaggaccaaaagggaaacgcgtccaaccgataaatcaagcgccgaccagaaccccgagatgcataataacgattttattactcttattattaacaggtcgggcatcgggaggggatgggggcgcgcgtttcctccgttccggctactcgtcccagaatttagccaggacgtccttgtaaaacgcgggcgggggcgcgtgggcccacagctgcgccagaaaccggtcggcgatgtccggggcggtgatatgccgagtcacgatggagcgcgctaaatcttcgtcgcggaggtcctgatagatgggcagtctttttagaagagtccagggtccccgctccttggggctgataagcgatatgacgtacttgacgtatctgtgctccaccagctcggcgatggtcatcggatcgggcagccagtccagggcctccggggcgtcgtggatgacgtggcggcgacgtccggcgacatagccgcggtgttccgcgacccgctgcgcgttggggacctgcacgagctcgggcggggtgagtatctccgaggaggacgaccgggcgccgtcgcgcggcccaccggcgacgtccgggggctggaggggggggtcttcttcgtagtcgtcctcgcccgcgatctgttgggccagaatttcggtccacgagatgcgcgtctcgaggccgaccggggccgcggtcagcgtaggcatgctctccagggagcgcgagttggcgcgctcccgccgggccgcccggcgggcctgggatcggctcggggcggtccagtgacactcgcgcagcacgtcctcgacggacgcgtaggtgttattggggtgcaggtctgtgtggcagcggacgaacagcgccaggaactgcgggtaactcatcttgaagtactgcagcaggtcgcggcagtgaatcgtcggaatgtagccggtgctgatgtccaacacgatatcgcagcccatcagcaggagatcggtatccgtggtatgcacgtacgcgaccgtgttggtatgatagaggttcgcgcaggcgtcgtcggcctccagctgacccgagttgatgtaggcgtaccccagcgcccgcagaacgcggatacagaacaggtgagccaggcgcagggccggcttcgagggcgcgcccgagggggccgccgggcctgggccggcggcccgcgttccccggtcccccggggcgaaggcgtgcccgcggcggcgcatgttggaaaaggcgaaactgggcctggagtcggtgatgggggaaggcggcggcgaggcgtctacgtcactggcctcctcgtccgtgcggcactgggccgtcgtgcgggccaggatcgccttggccccgaacacaaccggctcggtacactcgaccccgcgatcggtcacgaagatggggaacagggacttttgggtaaacacccgtaacatactacagagacagtgtagcgtgattgcctcgcggtcgtaacttgggtagcggcgctgatatttaaccaccagggtatacatgacattccacaggtccacggcgatgggggtaaagtagccctccggggcccggaggccccggcgcttcaccagatggtgagtctgggcaaacttcatcatgccaaacagacccattccggcacgattgtaggtgcggataggtctctctacagagctgtataggtgtgacggtccgggacacccaagcccgccgcccctgtgtacagtggctgcggcgacgaccccgctccaacaagacgctatcccgggaaaggcacgctctttataattcttttttatttcccatctacgtgcggattggtgcaaccgccggcgcgcgccggtgcaggccgaccatctctctcttccccccctccccctcccccgagccctcaaagagggtgtggcctaactagcggaaggcgtatttaaccagactagggcggcgggtccgccgtagtccttggctcgggtagccactgctctgtggctcgggtcccccggcccccctaacccccatccggtccgcgtcatccgccccctccgcctgcgacacaaacggccgcgcctccgggcccggtgacacgacgcgcctcgtctctgcggattgtcccgggagcgtcgcggcatggctcatcttcccggcggtgcggccgccgcccccctttcggaggacgcgatcccgtcgccgcgcgagcggacggaagactggccgccctgccagatagtgctgcagggcgccgagctgaacgggatcctgcaggcctttgcgccgcttcgcacgagccttttggactcgctcctggtcgtgggcgaccgaggcatccttgtacataacgcgattttcggcgagcaggtgtttctgcccctcgaccattcgcagttcagtcgctatcgatggggcggacccaccgcggcgttcctgtctctcgtggaccagaagcgatccctgctgagcgtgtttcgcgccaaccagtaccctgacctgcggcgggtggagctgacggtcacgggccaggccccgtttcgcacgctggtgcagcgcatatggacgaccgcgtccgacggagaggccgtggagcttgccagcgagacgctcatgaaacgcgagttgacgagcttcgcggtactactcccccagggcgaccccgacgtccagctgcgcctcacgaagccccagctcacgaaggtggtgaacgccgtcggggacgagaccgccaaacccaccacgttcgagctcggccccaacggcaagttttccgtgtttaacgcgcgcacctgcgtcacctttgccgcccgcgaggagggcgcgtcgtccagcaccagcgcccaggtccagattctgaccagcgcgctgaagaaggcgggccaagcggccgccaacgccaagacggtctacggggaaaacacacaccgcacattctcggtggtcgtcgacgactgcagcatgcgggcggtcctccggcggctccaggtcggcggggggaccctcaagttcttcctcacggccgacgtccccagcgtgtgtgtcaccgccaccggccccaacgcggtgtcggcggtgtttcttttaaaaccccagcgggtctgcctgaactggctcggccggagcccgggttcctcgaccgggagcttggcgtcccaggactctcgggccggcccgaccgacagccaggactcctcctccgagccggacgcgggcgaccgcggcgccccagaagaagaaggcctcgagggccaggcccgggtaccgcccgcgttcccggaaccgccgggaaccaagcggaggcaccccggggccgaagttgtccccgcggacgacgccaccaagcgcccgaagacgggcgtgcccgccgcccccacgcgagccgagtcgccccccctctccgcgagatacggacccgaggcggcggagggtggtggggacggcggccgctacgcgtgctactttcgcgacctccagaccggcgacgcgagccccagccccctctccgccttccggggtccccaaagacccccatacggctttgggttgccctgacggcaacgggtggtggccgaacgcctcaccgcgcccgggcacgcggggtgcgttgtgttaaaaaaataaataaatggggtagtgtgtcccccccccctccaaccaatatggctgtcgtgtgtggttccgggttgcgcctccgtcctttccaccccccttccccctccttttttgttttgcgtgcgcttataagagcgggcccggggcccttcgcagcttcaccgagagcgccgtcgggccccgggtgcgggatgtgtcgcggggacagccccggggtcgcgggcgggagcggcgaacactgcctcggaggggatgatggggacgacgggcgcccccgcctcgcctgcgtgggtgccatcgctcgggggttcgcgcatctctggctccaggccgccacgctgggcttcgtggggtctgtcgttctgtcgcgcggcccgtatgcggacgccatgtcgggggcgttcgtgatcgggagcaccggcctggggttcctccgcgccccccccgcgttcgcccggccgccgacgcgtgtgtgcgcgtggctgaggctggtcggcgggggagcggccgtggccctgtggagcctcggggaggccggcgcgcctccgggggttccgggcccggcgacccagtgcctggcgctcggggccgcctacgcggcgctgctggtgctggccgacgacgtccatccccttttcctcctcgccccgcggcccctgtttgtcggcaccctgggggttgtcgtcggcgggctgacgataggcggcagtgcgcgctactggtggatcgacccccgcgccgccgcggccctgacggcggcggtggtggcgggcctcgggacaaccgccgccggggacagcttttccaaggcctgtccccgccaccgccgcttttgcgtcgtctccgcggtcgagtctcccccgccccgatacgccccggaggacgccgagcggccaacagaccacggacccctgttaccgtcgacgcaccaccagcgatctccgcgggtctgcggcgacggggccgcacggcccgaaaacatctgggttcccgtggtgacctttgcgggcgcgctcgcgctggccgcctgcgccgcgcgagggtctgacgcggctccgtcaggcccggtcctgccgctgtggccccaggtgtttgtcgggggccacgcggcggcgggcctgacggagctgtgtcagaccctcgcgccccgggacctcacggacccgctgctgtttgcgtacgtcggattccaggtcgtgaaccacgggctgatgtttgtggtccccgacatcgccgtatacgcgatgctggggggcgccgtgtggatctcgctgacgcaggtgcttgggctccggcgccgccttcacaaggacccagacgccgggccctgggcggccgcgaccctgcggggcctctttttctccgtctacgcattggggtttgcggcgggggtgctggtgcggccgcggatggcggcgagccggcggtcggggtgatcgccatttcaaataaaaggcacgagttccccgaataccaccggcgtgtgatgatttcgccctaccgctccgatccccggggggaggggggaaggaaatgggggcgggggtgccgtggacgggtataaaggccaggggggcaggcgggcccatcactgttagggtgttaggttgggaggtggcacaaaaagcgacactcccgtgttgtagttgtccgcgggaggcggtggtttccggcaaccctcctcgctgcgccgggcgcgcccaccggtccttcgcgggggccggggctcttctggtcatggcccttggacgggtgggcctagccgtgggcctgtggggcctgctgtgggtgggtgtggtcgtggtgctggccaatgcctcccccggacgcacgataacggtgggcccgcgggggaacgcgagcaatgccgccccctccgcgtccccgcggaacgcatccgccccccgaaccacacccacgcccccccaaccccgcaaggcgacgaaaagtaaggcctccaccgccaaaccggccccgccccccaagaccgggcccccgaagacatcctcggagcccgtgcgatgcaaccgccacgacccgctggcccggtacggctcgcgggtgcaaatccgatgccggtttcccaactccacccgcacggagttccgcctccagatctggcgttatgccacggcgacggacgccgagatcggaacggcgcctagcttagaggaggtgatggtaaacgtgtcggccccgcccgggggccaactggtgtatgacagcgcccccaaccgaacggacccgcacgtgatctgggcggagggcgccggcccgggcgccagcccgcggctgtactcggtcgtcgggccgctgggtcggcagcggctcatcatcgaagagctgaccctggagacccagggcatgtactactgggtgtggggccggacggaccgcccgtccgcgtacgggacctgggtgcgcgttcgcgtgttccgccctccgtcgctgaccatccacccccacgcggtgctggagggccagccgtttaaggcgacgtgcacggccgccacctactacccgggcaaccgcgcggagttcgtctggttcgaggacggtcgccgggtgttcgatccggcccagatacacacgcagacgcaggagaaccccgacggcttttccaccgtctccaccgtgacctccgcggccgtcggcggccagggccccccgcgcaccttcacctgccagctgacgtggcaccgcgactccgtgtcgttctctcggcgcaacgccagcggcacggcatcggtgctgccgcggccaaccatcaccatggagtttacgggcgaccatgcggtctgcacggccggctgtgtgcccgagggggtgacgtttgcctggttcctgggggacgactcctcgccggcggagaaggtggccgtcgcgtcccagacatcgtgcgggcgccccggcaccgccacgatccgctccaccctgccggtctcgtacgagcagaccgagtacatctgccggctggcgggatacccggacggaattccggtcctagagcaccacggcagccaccagcccccgccgcgggaccccaccgagcggcaggtgatccgggcggtggagggggcggggatcggagtggctgtccttgtcgcggtggttctggccgggaccgcggtagtgtacctcacccacgcctcctcggtgcgctatcgtcggctgcggtaactccggggccgggcccggccgccggttgtcttcttttccaccccttccgtcccccgtacccaccacaccccaccccacccccccgccgtcccccgggcgttataagccgccgcactcgcttttcccaccggaaaatcctcggcccgatccgaacggcgcacgccgcgtgggctccaaacgcctccggaagagagcgccccgccccgatattcaagcccgcggtggtgctatggctttccgtgcttcgggacccgcctaccagcccctcgcccccgcggcctccccggcgcgggctcgtgttccggccgtggcctggatcggcgtcggagcgatcgtcggggcctttgcgctcgtcgccgcgttggttctcgtaccccctcggtcctcgtggggactctcgccgtgcgacagcggctggcaggaattcaacgcgggatgcgtcgcgtgggaccccacccccgtcgagcacgagcaggcggtcggcggctgcagcgcgccggccacccttatcccccgtgcggccgccaagcacctggccgctctgacacgcgtccaggcggagagatcgtcgggttactggtgggtgaacggagacggcatccggacctgtctgagactcgtcgacagcgtcagtggcatcgacgagttttgcgaggagctcgcgatccgcatatgctactacccacgaagccccggcgggtttgtccgcttcgtaacttcgatacgtaacgccctggggttgccgtgaggcgcgcgtccgacggtcccgcttctcgcctctcttcttcccccaccccacccaccgaccaacgacggcgtttggccaataccctccttttttctttttctcttccccccccccccaaaaaaaacaataaacagctaattgcgtacgacaaaccatgcggaactcgctgttttttttctctgtttgttactttttattgaaacagacatacggggaaaggggccggaaaccgagacggtggggccggcggtcgcatttttttaatggctctggtgtcggccgcgtttgagcttcgtcaacagggcgctgagggcggcgacgttcgtcgggccgtcgttggccagcgcgttggtccgggggcgggcgggcatgggcgacaggcttagtcccgggtccggggcgcgtgtggcccccggaggggagaagagggcagacccgccccagtcgtacaggggattttccgcctcgatgtacggggagtccggggcgtctcccggcagggcggccccgccggcaagacgccggcgagggcagatgttttcgtatacccgaacccaggggatctcctcgtagacgcgccccccatcctcgcccaccgactcgtaaatggaatctgcgtcctcggagggggcgcggggggcgtggctttcggccggccaggcggcggcggcggtggtgtcggcggcgggggtggcgccaagcccgacgcccgcgggcatggcggcgtcatcgtcgggcagcagatacgtgttttccatctggtccggttcggcctccgcgtccggcccccaggtccgcaccgcgtcgtagaccccggcggcctcgcgctgagccgcgagcgggcgcgccgcggctgccggccgctgctcggggggcgcggggttgcggggcgggaggcgcgggggcgccccggccatatgcgtgtaatacgtggccggccggccggcgcagggctcgggaccccggtcggccgcgtcgacgtgcgggggctcggggaggtcctcgcggtggcgcctgaacctccgaggggccgcgggggtcgagtgggggcgagcccgggggagcggcgggggtgcgttgtcgcgccgggtccgttgtatcttgtcccggcagctcccgccgaccgcgccgcggccccccggtgggccggacgccgcgaggcgcaggatggactcgtagtggggcgacggggttccgctccgaagcaggtccggggccagggcggccccgaaccaggacttgatgctgagttccatccgggcccagctcggggcggtcatcgtggggaacaggggggcggcggtcctgcagaagcgctcctggctgtccaccgccgcccgtaggtactcgttgttcaggctgtcggaggcccagacgacatacccggtaagcgtcgcgttaattatatactgggcgtggtggtggactatggatagaacctcgacggtcgagacgatggcgtccacgatcccgtacgtgccgccgctgcgcttgccggtctcccacaggtgggccaggcgcgtcaggtggcccaggacgtcgctgaccgccgcccgcagggccatgcactgcatcgagcccgtggtgccgctgggcccgcggtccaggtggcgcgcaaacgtctccgcgggcgcctccagactcccgctgagcgccacgaaccggcgatcggcggggcccaggcggcgacacacgtacttgtccgccgtccacagcatccacgaggcccaatggtacaacacggagacgtaggccaggagctcgctcagccgcagtgcggtgtccgtgctcggccggctcgggtctgcggggcgcataaagaacatgtactgctggagcctgtgggccgcgtcgcgcaaccccgccaccgcggcggcgtacttggccgcggcggccccgctcttgaacggggcgcgcaccagcagcttcgggagcagggtgggccgcagcagcacgtgcaggctggggtcgcagtcgcccgccgggtcgtcggggatgtccaggccgctgggcacgaccgtctggaggtacttccagtactgcgctaggatggcgcggctcagctggccgcccgacagctccacctcgccgagcgcctgcttggcggccgacgcgtagtgccggatgtagtcgtagtgcgggtcgctggcgagcccgtctacgatcaggctctcggggacggtgttatggtgccgcgccgccagccggacgctgcgatcggcgccggtcagaaacgccggctgcaggtcgtcggcgcgctgccgcaggacgcccacggccgcgctgaggagcccctccggggtggggagcagacacccggcgaagatgcgccgctcggggacgcccgcgttggcgccgcggatgaggttggccggcgtcaggcaccgcgccagccgcagggagctcgcgccgcgcgcccggcgttgcatggcggagaccgttcggtcgggggccccgccggtcggaggtatgccgcgtcccgggatatagggttgctttttatggggaggcgcctatgggcgtggcgggccgcccagcccggtcgcgcgcctcccggacacgtgcgcccggagggcggcggtctcctcgtcgcccatgagcagtttccgaaactgcgccatgatgtccacgacgcggacccgcggccccagcacggactcgctattcaggggggcgggggggaaggccgccaggtcttcgagcaggaaggcggggtctgccgtcccgctcacgggcgcccggggcgccgaggacgcggggcgaaggtccacgtgttccgcggcggcgcgcacgtccgcccaaaatttggcgggggtggtccgcgcgtacaggggctgggtcgcgcggaggacgcacgcgtagcgcaggggggtgtacgtgcccacctcgggggccgtcgacccgccgtcaaacgcggccagggccacgcacgcgaccaccgtgtcggccaggcccagcagccgctgcaggatgagccccgtcgccagcacggcgcgcgcggccgccgcgtcgtccctgcgccggcgcgcgtccccgcaggccagggcgtatttcagggtaacggtcgccagggccgtgtgcagcgcgtacacggccgcgcccagcacggcgttcagcccgctggtggcgagcaggcggcgcgccgcggtgtcgcccagcgcctcgtgctcggccgccacgaccccggggctgcccaggggcagggcgcgaaacagcgcctcctgctccacgtccgcaaacgcggggtgggcggagtgcgggtgcaggcgcgcccccacgaccaccgagagccactggaccgtctgctccgccaggaccgccagcacgtccaggacgcgccccgcaaacgcggcctcccgcgggagcacgcatttgacggcgccggggttgaagcgggcgagcagagccccggtggcgatgtacgtcatgcgccccgcgtagcgggcggccacgcgacagtcgcgccccaggagcgcgcgcaccccgggccagtacagcagggaccccagcgaactgcgaaagaccgcggcgtcggggccggggtgggggggcgcggcccctcccgcgctgagcagcggcacggcggcggcccccacgggccgcaacgccgtgaggctcgcgaactgccgtcggagctcggccgccctgtcgtcgagctccgagccgcgcccctccgtgtgcaggcgcgtcccgcagacccacccgttgatcgccacccgcacgatggcgtccaccagaaagcccatcgcgcgggaggggctggtttttgcccgccgatccgtcaggtcgaggatcgcgtcgcccgtgacgtaccaggccagcgcctcgccctgctgcagcgtctggcggaaaaacacctttgggtcggccggggaggcaaagtgcatgacccccacgcgcgacagcccgaacgcgctatccggacacgggtagaacccggccggatgtcccagggccagggccgagcgcacggactcgtcccacgcggcgactcggggggtcaggcggtccagggggaatgccgcctgcagctccgggcccgacacgcggcccgcgagaatctcgaccgtcgcggaaggccgcgccccggcgccgtcatcgtgcgcgacggcggcggggtagtcgtcctcctcgtagttgagctcgtccaggaacagcggcgagggcaccacccgcgaaccgcccacccgccccaaaacgtcgcgtgggtccatcgggcccaggtagcctccccgcggggcccgcgtgatggcgctgtcccggcgtccgcgaacggactggctcctggccgtaacggacctggggcgcggaaaggacgcccggcgggggggcgccgccgcccgggcctcggacgcgcgtcgggacccggggtgaccgcgggcctcccggcgacggcgcgggggcggctcttcgctcgccatctcccccgcggcctcgacctcgctgtcgtcgtccacgttaaacaccgcccgcaggtaccccattaacccgactccaccgccctcgggctcgtcctccacgggcgagtcggcgcgatgcgcggacggggcatgggaccgggtggaggcgcgcctccggcgtacggcatgcccgcgcacggacatggtggccggaggcccgattttttacacacgccctccccgcagacggacgaggaaaggggtggtgcgaggggggaggcccaaacggggaggtggggggtagggggcggtcccagggagcggggggtaggaaccggcacgacgggaacagagaaaacgcgaccgctccaacaagggtgggggggtgggcctcgtccccacgcagacccgcgggcaaatgcgagaacgggacccgcgcgcctgcctttatacgcggaccccagcaccacgagccgttctgtgacgcgaatctacacgaccgcgggctcgtaggcgcgactaacgcccaacccaacggcacacaccccccaccccgcgcgtaaccccatttctttcatggtcccgtaataaacagccaacgcacgccgcgtatgatgagttgcttgccaatgtttattgctgtggttgcgaaccctctatcgcgatacagacggaggtgaggcggggcggtggtgggggggggcgcgccgcccggtcgcacatcctaccccccaaagtcgtcaatgcccatggcatcggtaaacatctgttcaaactcaaaatcgtccacgtccaaagccccatacgagacggggtcgtgggtcattcccggggagggggactccacgtcccccagcatctccaagtcgaagtcgtccagggcgtcggcgggcgtcatatccacctcctcgccgtccaggcggagttcgtctcccaggctgacgtcggtaatgggggcggtggtggacagtctgcgggggcgttgtcccgcggagagaaacgacatgcgcggcgccaccagcccggcctccgcgggagcgtcatcgtcgtccgggaggtcgagcaggccctcgattgtcgatccgtaattgtttctggtccgcccgcggctatacgcgtgctcccgcatgacggactcgccctccgaggtcgcgacgctggagtacgagtccaacttggcccggatcagcagcataaagtacccagaggagcgggcctggttgccctgcaggacgggcggggtcgtgaggggcgccccgggttcctccgccgccgcacttcgcaccagcgggaggttcaggtgctcgcgaatgtggtttagctcccgcagtcgccgggcctccacgggaactccccgcacggtgagcgatccgttgataaacatcaggggctgaaacagacacgccaactggcgccagctctccaggtcgcagcagaggccgtcgaacagatcgggccgcatcatctgctcggcgtacgcggcccataggatctcgcggctcagaaagaggtatagatgcagaaacaggacgcgcgccaggcgcgcggtctcgcggtagtacctgtccgcgatcgtggtgcgcagcatctcccgcaggtcgcggttgcggccccgcatgtgtgcctggcggtgtagctgccgaacgctggcgcgcaggtaccggtacagggccgagcaaaaatttgccaacacggtccggtagctctcctcccgcgcccgcagctcaccgcggaaaaactgcgccatggcctcgtagtacgaaggcagctcgtcgcgggtggcgggcagggtggggaacgccacgtcgccgtgggcgcgaatgtcgatcggggagcgctcggggacgtgcgcatccccccagtcgatcacgtcgctgggcagcgtcgacagaaacttgcactcccggtacatgtcggcgttggtcgggaacccagagaacaggtcctcgttccaggtatctagcatggtacacagcgcgggacccgcgctgaagcccagatcgtcgaggagacggttaaacagggccgcgggggggacgggcatgggcggcgagggcatcagctgggcctgactcagccgaccggtggcgtacagcggaggggcggctggggtgttcttgggacccccggctggcctggggggcggtggcgaaaccccgtccgcgtccgcaaacagatcgtcgaccaacaggtccatgggggcggttgggtccgggaataacgatctcgagaggcgaatgagacgtgcccgagcgcccggcggcggagagggggggagggatccgggacccgcgacagaaaaaggccggggccctcgcgaagggaatcgccgggggtgccgtgcgtccccgaggactgacatctcgcgtccaccaccccgcatttaagtatcaccccagtgccgccccaaacctcgtgacttccccaccgctccgggcggcccgtcccccgcgctcggaagggaggcgtgtccttcctcccgcccctcccgcccctcccgcccctcccgcccctcccgcccctcccgcccctcccgcccctcccgcccctcccgcccctcccgcccctcccgcccctcccgcccctcccgcccctcgccacaaacgcgtgctgacagcgaagtggttaaatcgaccgtgatgctttattgtctgtcgtctgaacgcggtcggggtcgctactcgagggggcggcggggacgggaagccgagcgggcgggggcccgtgcggtcgcggcggcacgccccgcggggcggccccgggcggccgcggtcgcgtcgacgtcctgcgccgcgtcgggattcaccaactcgttcgcgcgctgcaggaggttcttgccctcgcagaccgtcacgcgaatggtggtgaggtcgaggagctcgttgaggtcttcgtcggtgtgcggccgcgacatgtcccacagctgtaccgccgccagccgggcgtgcgtggccgccaggcgcccgaccgcggcgcagaagacgcgcttgttgaacccggccacccggggggtccacggcgccgtggggctcggtggggcggtgctgaagtgcagcttcttggccagtccctgggcgggtgtcttggttcttcccgaggccgtgggagcgggggcgtctaggagcacggcggagtcggcctgggcgggtcgcctgccgcgggcggggtcggtcgccggggtcgcggaggccttaggcgccccgcgcgtcattttgggggtccgcgcgggaggggcgtgcgagcgcccgccggcgcccacggggcccccggggggtggaggagcgcgcgcggggccggggccgtgagagcccgcgacggacgccgaacgacgcggtcgcgcggtatcccgggactcgtcgtcgtccgaagacgagtcccggtagagggcatacccagcctcgtcataatggagaaagcgaacctcgcccctcgggcgcgcgcgcatcgggccagcgccgcggcggaagtcgtcgcgcggactctctgggtccgccggggagaccgggccatagtacagctcctcgtgggtcccgcgcggcgcttcccgcggacacgacttgacggagcggcgagaggtcatggtctatcggagacaccggggacgcccgtgcggatcacagggaaggcgtcggcgaaggaggcagagagcgtcggaaggcggcgagggagggaaagagggagaccggcggggtacgggagagcagcgagggcctgcgtaacccacgggggccgcgggagtggctccctgcgggttgcgggggagagtttataggaagtggatataaccgcaggcgacgggactaaccaatccccgggggggcaacggacagacacgccccgaacaggcccgacttccgcgaggaagcaaaggccgggggccgcccaacgacacgcccaccccttcccaacagggcgggctcaggctgacccggcggccagtgcccgctgacatatctgatacacgtgcgcgatcatacatacgcccatcgaggtcatgcctagataaaagggcaccaggacccccgggacggacaccacaccggcgctgtcgccccggcattgcgcgtccccgataacgccgcgtgcgcctgccgcgttcggcggctccccgggcacgcccgcgacgagcgcgacgaacaacagcaccacccagcggcccagtcttgcgggtttccccgtcatcgcggcgatgagtcagtgggggcccagggcgatccttgtccagacggacagcaccaaccggaatgccgatggggactggcaagcggccgtagctattcgcgggggcggagtcgttcaactgaacatggtcaacaaacgcgccgtggattttaccccggcagaatgcggggactccgaatgggccgtgggccgcgtctctctgggcctgcgaatggcaatgccgcgggacttctgcgcgattattcacgcccccgcggtatccggccccgggccccacgtgatgctcggtctcgtcgactcgggctaccgcggaaccgtcctggccgtggtcgtagccccgaacgggacgcgcgggtttgcccccggggccctccgggtcgacgtgacgtttctggacatccgggccacccccccgaccctcaccgagccgagctccctgcaccggtttccgcagttggcgccgtccccgctggcagggttacgagaagatccttggttggacggggcgctcgcgaccgccgggggggcggtggccctgccggccagacggcgcgggggatcgctggtctacgcgggcgagctaacgcaggtgaccaccgagcacggcgactgcgtgcacgaggcgcccgcctttctgccaaagcgcgaggaggacgcaggctttgacattctcatccaccgagccgtgaccgtcccggccaacggcgccacggtcatacagccgtccctccgcgtattgcgcgcggccgacggaccagaggcctgctatgtgctggggcggtcgtcgctcaatgccaggggcctcctggtcatgcctacgcgctggccctccgggcacgcctgtgcgtttgttgtatgtaacctgaccggagtcccggtgaccctacaagccgggtccaaggtcgcccagctgctcgtcgcggggacccacgccctcccctggatcccccccgacaacatccacgaggacggcgcattccgggcctaccccagaggggttccggacgcgaccgccaccccccgagacccgccgattttggtgtttacgaacgagtttgacgcggacgcccccccaagcaagcggggggccggggggtttggctccactggcatctagaccgcgcctcgcgtcgggccagatggggccccggtcaataaagagctctgtttcgcatatgccctggtgttggcggttttttttgttgtctgtctgcccggcgctcggttgtccgttctgtcgtcgctatcacatacgcacaaacacacgggtagagtggaaccgaaaccggtcgacgtttattcaccacacagaaacacaagctaagcgagaaggaggggggcctcggtcgacgaggcctggcgtttgggggcggacgtgcgatgacgtgggtccggtgtagggtccgcggggggcacgggcccggggcgaacgggggatctgtcgccggcgtgggtgactgggaccgacgcaacctccggggcttgtgccctcgtaggcccggggggggcctcggtcgctccaagccccgcggtgcgggtccctccggccagagccgaggtggagagaccaagggcccgctccgcgatcgccacgtcctccatgaccacgtcgctctcggccatgctccgaatggcctgggagacgagcacgtccgccgacttgtccgcggcccccaccgacatgtacatctgcaggatggtggccatgcacgtgtccgccaggcggcgcatcttgtcccgatgcgccgcaacggccccgtcgatggtggagccctcgagtcccgggtggtggcgcgccagcctctcgaggttgaccatgcaggcgtggtatgtgcgggccagggcgcgcgccttcacgaggcgccgggtgtcgtccagcgactctagggcgtcgtcgagcgtgatgggggcgggcaaaagcgcattgaccaccgccagggcctcctgcagccgcggctccgcctccgagggcggagccgcggcccgaatcatctcatattgttgttcctcggggcgcgttccccaaccgcacagcaccccgagcagggacgccatcccggaacacgcgcgcggctctgcgccggctttcccccaccccaccccctccgggttcgcaggggcgatggggacggaagactgcgatcacgaagggcggtcggttgcggctcccgtggaggttacggcgctgtatgcgaccgacgggtgcgttatcacctcctcgctcgccctcctcacaaactgcctgctgggggccgagccgttgtatatattcagctacgacgcgtaccggtccgatgcgcccaatggccccacgggcgcgcccaccgaacaggagaggttcgaggggagccgggcgctctaccgggatgcgggggggctaaatggcgattcatttcgggtgaccttttgtttattggggacggaagtgggcgtgacccaccacccgaaagggcgcacccggcccatgtttgtgtgccgcttcgagcgagcggacgacgtcgccgtgctccaagacgccctgggccgcgggaccccattgctcccggcccacgtcacagcaactctggacttggaggcgacgtttgcgctccacgctaacatcatcatggctctcaccgtggccatcgtccacaacgcccccgcccgcatcggcagcggcagcaccgcccccctgtatgagcccggcgaatcgatgcgctcggtcgtcgggcgcatgtccctggggcagcgcggcctcaccacgctgttcgtgcaccacgaggcgcgcgtgctggcggcgtaccgccgggcgtattatgggagcgcccaaagccccttttggtttctgagcaaattcggcccggacgaaaagagcctggtgctggccgctaggtactacctactccaggctccgcgcttggggggcgccggagccacgtacgatctgcaggccgtgaaagacatctgcgcgacctacgcaatcccccacgacccacgccccgacaccctcagtgccgcgtccttgacctcgttcgccgccatcactcggttctgttgcacgagccagtactcccgcggggccgcggccgctgggtttccgctgtatgtggagcgccgcatcgccgccgacgtacgcgagaccggcgcgctggagaagttcatcgcccacgatcgcagctgcctgcgcgtgtccgaccgggaattcattacgtacatctacctggcccactttgagtgcttcagccccccgcgcctggccacgcatctccgggccgtgaccacccacgaccccagccccgcggccagcacggagcagccctcgcccctgggtcgggaggcggtggaacagttcttccggcacgtgcgcgcccagctgaacatccgcgagtacgtaaagcaaaacgtcacccccagggaaaccgccctggcgggagacgcggccgccgcctacctgcgcgcgcgcacgtatgccccggcggccctcacgcccgcccccgcgtactgcggggtcgcagactcgtccaccaaaatgatgggacgtctggcggaagcagaaaggctcctagtcccccacggctggcccgcgttcgcaccaacaacccccggggacgacgcggggggcggcactgccgccccccagacctgcggaatcgtcaagcgcctcctcaagctggccgccacggagcagcagggcacgacgcccccggcgatcgcggctctcatgcaggacgcgtcggtccaaacccccctgcccgtgtacaggattaccatgtccccgaccggccaggcgtttgccgcggcggcgcgggacgactgggcccgcgtgacgcgggacgcgcgcccgccggaagcgaccgtggtcgcggacgcggcggcggcgcccgagcccggcgcgctcggccggcggctcacgcgccgcatttgcgcccggggccccgcgctccccccgggcggcctggccgtcgggggccagatgtacgtgaaccgcaacgagatcttcaacgccgcgctggccgttacgaacatcatcctggatctggacatcgccctgaaggagcccgtcccctttccccggctccacgaggccctgggtcactttaggcgcggggcgctggcggcggttcagctgttgtttcccgcggcccgcgtagaccccgacgcctatccctgttattttttcaaaagcgcctgtcggccccgcgcgccgcccgtctgtgcgggcgacgggccctcggccggtggcgacgacggcgacggggactggttccccgacgccggtggtcccggcgacgaggagtgggaggaggacacggaccccatggacacgacccacggccccctcccggacgacgaggccgcgtacctcgacctgctacacgaacagataccagcggcgacgcccagcgaaccggactccgtcgtgtgttcctgcgccgacaagatcgggctgcgcgtgtgcctaccggtccccgccccgtacgttgtgcacggctccctgacgatgcgtggggtggcgagggtgatccagcaggcggtgctgttggaccgcgacttcgtggaggccgtagggagccacgtaaagaactttttgctgatcgatacgggcgtgtacgcccacggccacagcctgcgcttgccgtatttcgccaagatcggccccgacggctccgcgtgcggccggttattgcccgtcttcgtgatcccccccgcgtgcgaggacgttccggcgttcgtcgccgcgcacgccgacccgcggcgcttccactttcacgccccgcccatgttttccgcggccccgcgggagatccgcgtcctccacagcctgggcggggactatgtcagctttttcgagaagaaggcgtcgcgcaacgccctggagcactttgggcgacgcgagaccctgacggaggttctgggccgctacgatgtgcggcccgacgccggggagaccgtggaggggttcgcgtcagaactgctggggcgaatagtcgcgtgcatcgaggctcactttcccgagcacgcgcgggaatatcaggccgtgtccgttcgccgggccgtcattaaggacgactgggtcctgctgcagctgatccccggccgcggcgccctgaaccaaagcctctcgtgtctgcgcttcaagcacggcagggcaagtcgcgcgacggcccggacctttctcgcgctgagcgtcgggaccaacaaccgcctatgcgcgtccctgtgtcagcagtgctttgccactaaatgcgataacaaccgcctgcacacgctgtttaccgtcgatgcgggcacgccatgctcgcggtccgctccctccagcacctcacgaccgtcatcttcataacggcctacggcctcgtgctcgcgtggtacatcgtctttggtgccagtccgctccaccgatgtatttacgcggtgcgccccgccggggcgcacaacgataccgccctcgtgtggatgaagataaaccagacgctgttgtttctgggcccgccgaccgccccccccggcggggcatggaccccccacgcccgcgtctgctacgccaatatcatcgaaggtcgggccgtgtccctcccggccatccccggcgccatgagccgccgggtcatgaacgtgcacgaggccgtaaactgcttggaggccctctgggacacccagatgcgcctggtggtcgtcggttggtttctgtatctagcgttcgtcgcccttcaccaacgacgatgcatgttcggcgtcgtgagtcccgcgcacagcatggtggccccggcgacctatcttttgaactacgccggccgcatagtgtcgagcgtgttcttgcaatacccctacacgaaaatcacccgcctcctctgcgagctatccgttcaacgccagaccctggtgcagctgttcgaggcggatccggtcaccttcttgtaccaccgcccggccgttggcgtcatcgtgggctgcgagctgctgctccgcttcgtggccctcggtctcatcgtcggcaccgctctcatctcccggggcgcctgcgcgatcacacaccccctgtttctaacaatcaccacctggtgtttcgtgtccatcatcgccctgacggagctgtatttcatcctgcggcggggctcggcccccaaaaacgcggaaccagcggcccccagggggcgctccaaagggtggtcgggcgtctgcgggcgctgctgttccatcatcctctccggtatcgccgtgcgcctgtgctatatcgccgtcgtggccggggtggtgctcgtggcgcttcgctacgaacaggagattcagcggcgcctgtttgatctgtgacgtaacgcctcttccgttggaagaggcggacccagtcgcccatgcaaattaaatacacgacccgcctcgggcctacgcaccctcgcacgtcgcatgcaaattaaaatcgtgcacagagccgatccggcctcgggtctgcttgcccctcccccggcccagcacaggcaggctcgtccgacttccgcatacaccccaccctaccgcgtgcttccgcacccccgcctacgcgtgtacgcgaaggcggacccagacctgccgtatgctaattaaatacataaaacccaccctcggtgtccgattggtttctggggacggcgggggcgggggcggtgacgcccgacggggagggacaaggaggagtttcggaaagccggccccggtcgtgcgggtataagggcagccaccggcccactgggcgctgtgtgctgccgtgtgccgaccccggttgcgcgtcggtgccgctcctcgattcggacccggccactctcttccgacacgcgccccctcggaggacacccgccatcccagccccggcgacctacaacatggctaccgacattgatatgctaatcgacctaggattggacctgtccgacagcgagctcgaggaggacgctctggagcgggacgaggagggccgccgcgacgaccccgagtccgacagcagcggggagtgttcctcgtcggacgaggacatggaagacccctgcggagacggaggggcggaggccatcgacgcggcgattcccaaaggtcccccggcccgccccgaggacgccggcacccccgaagcctcgacgcctcgcccggcagcgcggcggggagccgacgatccgccacccgcgaccaccggcgtgtggtcgcgcctcgggaccaggcggtcggcttccccccgggaaccgcacggggggaaggtggcccgcatccaacccccgtcgaccaaggcaccgcatccccgaggcgggcggcgaggtcgccgccggggccggggtcgatacggccccggcggcgccgactccacaccaaacccccgccggcgcgtctccagaaacgcccacaaccaagggggtcgccaccccgcgtcggcgcggacggacggccccggcgccacccacggcgaggcgcggcgcggaggggagcagctcgacgtctccgggggcccgcggccacgaggcacgcgccaggccccccctccgctgatggcgctgtccctgacccccccgcacgcggacggccgcgccccggtcccggagcgaaaggcgccctctgccgacaccatcgaccccgccgttcgggcggttctgcgatccatatccgagcgcgcggcggtcgagcgcatcagcgaaagctttggacgcagtgccctggtcatgcaagacccctttggcgggatgccgtttcccgccgcgaacagcccctgggctcccgtgctggccacccaagcgggggggtttgacgccgagacccgtcgggtttcctgggaaaccctggtcgctcacggcccgagcctctaccgcacattcgcagccaacccgcgggccgcgtcgacagccaaggccatgcgcgactgcgtgctgcgccaggaaaatctcatcgaggccctggcgtccgcggatgagacgctggcgtggtgcaagatgtgcattcaccacaatctgccgctccgcccccaggaccctatcatcggaacggcggccgccgtgctggaaaacctcgccacgcgcctgcgcccctttctgcagtgctacctgaaggcccgaggcctgtgcgggctggacgacctgtgctcgcggcgacgcctgtcggacattaaggatattgcctcctttgtgttggtcatcctggcccgcctcgccaaccgcgtcgagcgcggcgtgtcggagatcgactacacgaccgtgggggttggggccggcgagacgatgcacttttacatcccgggggcctgcatggcgggtctcattgaaatactggacacgcaccgccaggagtgttccagtcgcgtgtgcgagctgacggccagtcacactatcgcccccttatatgtgcacggcaaatacttctactgcaactccctattttaggcaagaataaacatattgacgtcaacccaagtggttccgtgtgatgttcttggcgcgcgcggcgggtggggcggagactccggggcgatgccggcgtgcgcgtgggaggagggcgatgacccaccggataaatgtggggccccggcccggcccgcttcatagcgcgtccaggaactcacggcagacgcgtattcaccgacccccccctcgcaacatgacaacgacgcccctctcgaacctgtttttacgggccccggacatcacccacgtcgcccccccgtactgtctgaatgccacgtggcaggccgaaaacgccctgcacacgaccaaaacggaccccgcgtgcctggccgcgcggagttatttagtccgcgcctcctgctcgaccagcggccccatccactgttttttctttgcggtgtacaaggactcgcagcactcccttccgctggttaccgagctccgcaacttcgcggacctggtcaaccacccgcccgtcttgcgcgaactagaggataagcgtggggggcggctgcggtgcacgggcccattcagctgcggaaccatcaaggacgtctccggtgcatcccccgcgggggaatacacgataaacggtatcgtgtaccactgtcactgtcggtatccgttctccaaaacctgctggctcggggcatccgcggccctacaacaccttcgctctataagctcaagcggcacggccgctcgcgcggcagaacagcgacgccacaaaatcaaaatcaaaatcaaggtataacccacccccttccctccgagtccgtatgcaacctcattaataaagagtgagaaccaaccaaaacagacgcggtgtgagtttgtgggttataggaacccggtaaataccacgcgacgaaccagcatgtgtgttaacgcaacttttattcgttgtatcgcgggaggggggaagcttaccgccaaaggaaggccaagatgataacgacgaccaccgcgaccaccccaaaaaccgcatgacgacacgtcccgccacaccaccctggggcttggggcgtgtcggagctcgacgcacagcgggccgcgcgttgggcccggtacagctctcgcgaattgacaagcgggggtcgccacgtgcgcgagctttgcacgcggggttggtcggccggccccacggacccgcccggtggctcggtcggacatgcggccatgaccatggcgtaggtgggggggcgatccgaggtcgcctctgcgtaagtagggaggcccgacgggaggtcgcctcccacgccagggtgggccccaatcatagtttccggtagaaacaggggggtctccacaaacaacccccctgggccaaagctccggcgccgcgcccgtcgttcggcgcggcgcctggcgcgccgagcggcccgccaggcggcgcggcgcgagcggccacgctcacacacctcgccgtcaccggaagaagccggtgaaacaagcccaaccggcgacgtccctgcagagtacggtggaggcgagtccgtgggggtgtcgatatcaataacgacaaactggcccgcgctcgcgccggccacactctcgtatgggggcggggcgtcaatcacgctatcatctccgtcatccctgcatgcgtgggcatgcccagcccccaacgccatggtggggattcgcggctcagaagcctgcatgtcgtgtggtcggtcgtagtccaacgtgcctcccccacccaccacacagccggtccccacgccgaccactagaccgcagacgtcgcccaaccgaggtccccgtgcacagaccgcgccttttatagccccaggggttgctaattaacgcacgcatgcagacgcaatttattttgctcccccgcgtcctcccctcccctgcgcacacgtgataggtcttgggaacccgaggggcgacgcggggaaagcgcgcccccgcccggccgccgcgcgcccccgcccggccgccgcgcgcccccgcccggccgccgcgcgcccccgcccggccgccgcgcgcccccgcccggccgccgcgcgcccccgcccggccgccgcgcgcccccgcccggccgcccgcgtcgcgccggcgccccctcccggcgcttccggggtctttccttccttccccgccgcgaccccggccccgccccaccgccccgcccggcaggggggccccggcgccgcgcagaacacacagacgaacacacggtggcgatcttttctttacttcggcggaccagcgagccccggccccggcccgcgccccgccgccacacccacggcaccccccccccgccgcccaccccggggtccacacaggagcgcgcgggcggcagaaacgcgggcgcggcggcggtcggggtgggagtggtggtgggggacacgaaaacacacccacgacactctccccccaccccgaccgccgccgcgccccaccggcgggatcgcggcgagacgcagccgggcccccccccaccacccgcccacccacctaccccgcgcccgcagcctccggcagcacgccgaccaccgccgccaccccccaaacagccaaggcgcggtggggggcgtggtggtgaacgatggggggaacacgggggggaggggtccggggcgaggcgggcgggcgaaggaagggggggtggtggcggcggcggtggaaagcggaaaaacggaggatggaagggcagaagatggggagtcccgatcctcctcctgcatcccctcgccttccattctccggccctccgcgagtcccgacgccccccccccgccgcccgacgaaggagacccaagcaccgcagccggagaggccgagcggggagtgggcggccgggcgggaggatggcggagagagagagagagagagagagagggggggggggggagagggaaagcaacgggaaagagaggcgcgcggaaaagcagcaagaggggggacggggcgagccgggcagagtgcggagcccccggagcccgcggccgcagccgagcagcgccgcgggctccggggccgggccgggccggcaacgccccgcgccggccgcggcggagagaacccctgtgtcattgtttacgtggccgcgggccagcagacgggccgcgggccagcagacgggccgcggcgccagcggcccacgcctcccgccgcattaggcccccgcgggcatccggcggccggccccacgcccttccattaaacactcccacgttgggggggggcgcgccagctgagtgctctgcggttgcgggcgccgtgcccggagatccattaagccgccggagagcccgagccccgcccgcgtgttgctgtgggcatttctgctgcgtcatccctgtctttataaaaccgggggcgcggcagcaacgaacgcaggggcccgccgccgatcgagagggactccggagaaggaaggctgctccgcgcaccggcgcgcccttctcctctcccctccctacctccccctctcttcccccttttttcccccgcctcccgtcttcttccgcgcctccgagggtccgcctctgcctcggggacccccgggcgggccggggcttggccgccgaggtgcgccccggccggaggggcccccgcacctcggcggccgccccctccggcgccgcgcgttcgcgaaaggcgcgaaaggggcccccggaggcttttttcgattcccggccgggggtcccgggtagccgcccggcgccgggcggaaggcgtcccccgcccggcggtccggcccgggcccccggcggagcgcgggggccccggggccccgggccgcgccggcggcgtttccgcgttccgtttcttctccctcccggccgccccgctcccgggcccgaccctcgccccttcccttctcctcgtcttcccccgtcccgccgcgccccttccctcttccttctctctctctgtctcgctctcctcacatttcccccccccccccgccgccgccgccctctgcccgcgtcccaccgagacgccgcgccgcgtgagccgtccgccgggggacccaggctccggggggggggggcgcctgcgtgtgtctcgtgtgagagagcgcgcccctcgaacgccgcgcgttctcgcaggtaggtttagggtcgtacaggtgagcttctgctgaggcggcgggagagggggggggggcgggcggaagagagaagagagcaggggttgggggagaactgttcttcctccccctttcaagaaacacgaggcgggggtcccagaaagggcaggcaggtcagccgcaccgcccgcgagccaacccgtatcctttttttctaggtgtttttgtttttgtttctgtttttgtttgttttgttattattttcgcggatccggcgtgttcggatccaccccccctttctccttcctcttcccttccacccacccccgtttcccccccccgtggtgtcgtccgggggcgtcgttcccagggggggcaggcgcgggtcgggcccatacgcccaccgcccccacgcgccggtcacccccccccaacaaccccaaaggcgcgtgcccagccacagccgtgggtgtggcgcccgtccccttcctctaccgcgtgggcgcgggcgggggggtggtggtagtggtggcggaaggaaacgggccgggggccggggccgctagggaaaggtaggcacgcgcgcggtgtgtcgacttgcatgccccgcaaaacgcgtcgtgtcgtgttgtgtcgtggtgggccgtgttgtggtgggccgtgtggtgtggtgtggtgttgcgaacgcgcgagccccctcgccccgatgggagtctccccgcagccagggtaaggaggggcgggcgtggcgggcaggtgtgcgggcggggtggggtgagtgcggttgcatgcctcgggtctcctcttcctgctcctcctcctttctcccagccagggtgaggaggggcgggcgtggcgggcaggtgtgcgggcggggtgggcgccggggcgggggtgggcacgggcgtaagtgcgggtgcatgcctcgggtcttctcttctccctcctccttcctcccacccgtccccgggggcagagggcgtgcatgcgttgtgattcaaccgccctcgcccccgccccactttccccccctctctatcaaagttccctggcccctggcttcgcgccggtggtgcggctgaccccccccctcctccctccccgagccaggcgccctcccactcctgcccaccacccccagggtctggccggccagacgtgcgtgctctgcacgatcgggcccccctccctgtcaacacggacacactctttttttacccgccagccagcccgcccacccaccaagacagggagccagaacgcaggccgggccccggctctgttctatcataaagaccaacaggcctcgggggtgggggcggcttctcgtgcccgccccccctcctcctcctccctttccccccccccatccccggcccccctgcgcgggggagctgcatcaaaggccaacaacaaagtgtgtcaaaagcatcacaaaactttattgtaaaatttttataaatataaagttttttttcctcaagttttcaacaaggccagaaagtccataacaaaatgctggtgtgtgttgctgttcggggccgtgtccgtccccccccactcccacccccacttcctgtctcctccccgtctttcccccccacctccccctgcccccgaggcgcctcggccggtggtccggtggggggcggcttccctttgggcagcaagccgagtgttagctccccctactccccgtggcccgcgggggcgtcgccggccggcgcgggcgcgccctgctcccgagaccacgggtggcgcgaccggaggccgtggaagtccagcgcgcccaccagggtgccctggtcaaagagcatgttgcccaccggggtcatccagaggctgttccactccgacgcggggggcgtcgggtagtcggggggcctcacgcagttgcgcgcgtgctcggggagcagggtgcggcggctccacgcgggggccgcggcccgcagcaggtccgccacgttccccgtctggtccacgaggaccacgtaggcccctatgtggcccgtctccatgtccaggacgggcaggcagtcccccgtgaccgtcttgttcacgtaaggcgccagggccacgacgctcgagacccccgcgatgggcaggtagcgcgtgaggccgggcgccgggtcgcgggccccgggctcggggccgccctccgcgtggcgcgtcttcctggcacacttcctcggcccccgcggcgcagcagcgcgggggccgagggaggtttctcgtctctccccagcgccggacgcggacgcgacgctcccaccagccccgcccgcagaggaagaggcggaggaggaggaggaggaagaggaggcggcggaggaggaagaggcggcggaggaggaagaggaggcggcggaggaggaagaggaggcggcggaggaggaagaggaggcggcggaggaggaagaggaggcggcggcggcgaccgcggcctgggacgacggagacgccgacgggggcgcggcgcccgcggacgccggggcgagcggcccgtggccgcggtcgcccgagtccgagtccggggcccggcgcggcgccgccctcttggcccccaccccctggggggcgaggggcgagcgcggggcggcggaggaagaggcggaggacgaggccgcagggcccgagtccgacccgcgcctcttccgggggcgggccgccgccccctccgcggcgtggggggcggcaccgggggtgttggtgccgcgggggaccccgggtcctccctccgcgcccggccctcccgacccgcgcgcgtcggtcgcgcctgcccggcccagactctgtgcttgggtgtcggtctgagcctgggtcatgcgcgaccggggcgcgcggtgcgcgtccaccggcacggcgggcggcgcgggcccggccgcgtccgcgctcgcagacaccacgggggcggcggcggcgcggggcggactccggacgcgcggggcgacggccgcgcgggggcgcgccgcgcgccccgacgactgtggcagacctccccccccggggcccgaggacacctgcgcggaggaggaggagaaaaaggagagcggcccggggcccgcggggcggcgcggagacggcgggggagagtcgctgatgactatggggggctcctgggccgcgcggggctgtcccgcggggggcgtcctgccctccgccgccgcggcgtcttcgcccacccgccgcgcctgcgcgcgccccccgccggccgcagggggaagagaggccactctcggcacgacggccgcgacggcagggccgcccccagacccagatcccacccccgcccgcaacggggcgccgccgctgctgctgctccgcggggcgccagggggcgccggtcgggtcgcggcgggctgggaggttccgcgggtcgcccccgcaccgccgcccccgcgccggggcgctcttcggggggcgggcgggacgtagtccactgcagagggagacagagacgggagcccccggttagtgcccgacccccgcccgacccccgcccgacccccgcccgacccccgcccgacccccgcccgacccccgcccgacccccgcccgacccccgcccgacccccgcccgacccccgcccgacccccgcccgacccccgcccgccctcaccgtcggccaggtcatcgtcctcgtcgtccgtgccgggccacgggggggtgggcgacagggcgcggaccgtgtgtccccccagcgacagggagcgcggggccgtccgctggttgcccgtccagataaagtccacggccgtgccggcccgcacggccgcctcggcctccacgcgggtccgggggtcgttcactatcgggatggtgctgaacgacccgctggcggtcacgcccactatcaggtacgccaccggggtgttgcacaggggacacgtgttgcgcaacggaatccaggtcttcatgcacgggatgcagaaggggtgcaggcagggaaaactctggcagcgcaggggcggggcgatctcgtccgtgcacacggcgcacacgtcgcccccccctcccgcttccgcttcctcctcacccacgggcccacccccgcaggatccctgcgcgtcggcgggcgtggggctgccctggcgctcggccgggggccgggccgggggcgtggccgcgtccatcaggcccgcctcgaacatctccgtgtccgtgctgcccgcctcggaggtggagtcgcggtgaaggtcgtcgtcagagattcccacctcggtctcctcctccgagtcgctgctggcgagccactgcatgtcgttgagcatcccccaggcgtgcggggcggcgggctgcttgacaaagcaacgggggggatttagagggcgcggggcgtgaggcgggacccccgcgccgtgtcccccgtgtccctccctcaccccggccccccgcccgctgctttttgttcggaagggggggagaaaggggtccgtaaccaaaggtggtctgcgtcctttggattccgacccctcgtctccccccctgtcccccgctctcgggctcctccctgcctccctcgcccccccagagggtcggggggcggcgcacggcccacgggggtcccccgaccgcttaagcgggccgggggtcggccccgtcaagcgtccccgcccccgagcccaccgcccgcgaccacccccaacccgcagccgggtggtccggggaaaagggggggcctgagacccgggggtcgccctctcaccgtgccgggggtctgccgcggcggccgctcggggccggggtccgcccgggagctcgtgccgggccggggttccatgagccggggtagggtagactcgagacggcggcccgcggtctctctcttgccgggttttagtctctgtctctccgggtctcctcctcccgccgggccgccgctccgtcgctcgcagtgccggggtgcgaatgcggcccgaccgtcacacggggctgccttatacccggcgcctatccactcccccaaaggggcggcatttacgattcccccaatagccgcgcgccccggcgggggcggagggagggaatccccccctctcggggcggccccgtccccggggaccaaccgggtgtactccaagaaccccattagcatgcgccgccccccgccgacgcagatgggagtccccccggcgccccgccggcgcggccctgagtggtgcccgcccccggggagaaattcattagcatactaggaagcccaggggaccaataggggccgatcagcccacccacccggcggcgcgcgaggctctgcgtgttctgccaagaaagtaatcagcataacccggaaccccgagggagtaattacgcggggagcgaggggccgtccgaacgtttttaattaccataagcgggaatggcggcccgttaaaagctgctaattaccgcgagcgggaacgccggcccattaaaagttgctaattaccatgcgcggggatggcggccgggaccgcctattaaaagtttctaattaccataccgggaagccggtctagaggatccccgggtaccgagctcgaattcatcgatgatcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggatccatgtggctgcagagcctgctgctcttgggcactgtggcctgcagcatctctgcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggagtgactcgagctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccaggttatccgtgtaaccgccagtccgtgcttgcctagcgaactcacccgtcccggctggcgtgcgcagcccgggccgtgttgcgggccctcttaaggggcggcggcaggacggggactcccgccccgcctcttttcccccggggagtcaacccccggggggggtgttttttgggggggggcgcgaaggcgggcggcggcggcgggcgggcggcagggcagccccgcgcgcccccttccccgtccctcccccggagccggccgctcccccgcgggcgccgcccctccccccgcgcgccgcggggctgccttcccgcgggcgcccccgcgcggcttttttcccgcgcccgcccccgcgcggcaagacggggactagcaggctgtgccgcagaccaccacacactcccaagctccccgcccccccgaagacgccagtcgcaccaccgctcgccctcgcagaccagacagttgcaccaagcacccgcccgcccgcacacggttccccgccaccccctccctcccctccatcccgccgagctcgcggcagcccctcccccccgcgcgccacggggctgcggtcccgcggccgcctcccccgcggccgcctcccccgcgccccgccccgggggcttcccccgcccctccccccgcgcccgcggccccgagctcgcagcagcccctccctcccgcgccccgtgccttccctcccgctcctgcgggggggctcgggccacctgaccttcgtaacctgcactcaggtcagagccccagaccccccgcgggcgcgggagacgtgccgcccacccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgcccgcccgacccccgaataaaccacacaaggcggtacgttttcgtctgtctcgttctttatttctcacacacgcgcgcggccatcgccgcgtctgtcttaaaggcgcacagacgcccgattccttccccctctccccatctcccccctcccccgctcccggaagtttcccccccgtcactccccaaacagtccgtcgtcgtcgtcctccagctccgcgtccatgtccacgggctcgcgcctcggcggcgtggccagccccgcggcggtccccaccacctccacgccgccgcccgccgcggccagcaccgtccccgcgcggcccgcggccgacgcccagcgtatctgcgggggcgggcccgcgtccgcgtcgtcgcgcagcaccagcgggggcgcgtcgccgtcgggctcgagcagcgcccgcgcgcagaactcccgccgcggcccgcgcagctccgccgggccgccgcgcacggcgtcgcgccccagcgccacgtagacgggccgcagcggcgcgcccaggccccagcgcgcgcaggcgcggtgcgagtgcgcctcgtcctcgcagaagtccggcgcgccgggcgccatggcgtcgcccgcgcccgaggcggcggcccggccgtccagcgccgggagcacggcgcggcggtactcgcgcggggacatgggcaccagcgtgtcggggccgaagcgcgtgcgcacgcggtaccgcacgttggccccgcggcagaggcgcagcggcggcgcgtcggggtacaggcgcgcgtgcgcggcctccacgcgcgcgaagacccccggcccgaacacgcggccggaggccagcacggtgcggcgcaggtcccgcgccgccggccagcgcacggcgcactgcacggcgggcagcacctcgcaggccaggtaggcgtgctgccgcgagaccacgggcccgtcggcgggccagtccgcggcgcgcacggcgttgacgacgatgaggcggcggtcgcaggcgccggccagcagccccaggaactccacggcgccggcgaaggccaggtcccgcgtggacagcagcagcacgccctgcgcgcccagcgccgagacgtcgggggcgccggtccagttgcccgcccaggcggccgtggcgggcccgcagagccggttgcccagggccgccagcaggcaggacagcccgccgcgctcggcggaccactccggggggggcccgcccccggcgcggcccgcggccaggtcctcgcccggcagcggcgagtagaggatcaccacgcgcacgtcctccgggtcgggcacctggcgcatccaggccgccgcgcggcgcagcgggcccgaggcgcgcagcgggccgaaggcggcgggcgcgccgccggggggcggggcggcgcagcgcgcggccagcgaggccagcgcgcgcgggtcgaacatgagggccgggcgccacggcgcggggaagagcgggtggtccgtgagctcggccacggcccgcggggcgcagtaggcctccagggcggcggccgagggcgccggcgtgtggctgggccccggcggctggcggcgccagccgccctgcgggtcggggccctcggcgggccggcgggtcagcgccgcggggcgcggcggccgcggcggcggcgtcggcggggcggggggcgcggcccccgcgggaggggcggccgcggggcggggggcgtccgcgcggctcttcttcggggggcgcggggcgccgcccggcggcgccctggccggggcggggctcttgcgcttgcgcgcctcccgcggcgcggaggcgggcgcggcgagcgagtcggccgcggcgacggtgtcggccagcagggggcgcaggctctggttctggaagagcaggtccgcggcggcggcggcggcggagctcagcaggcgcgggctccgcggcagcgccgggcccagggccccggcgaccaggctcacggcgcgcacggcggccacggcggcctcgctgccgccggccacgcgcaggtccccgcgcaggcgcatcagcaccagcgcgtcgcgcacgaaccgcagctcgcgcagccaggcgcgcaggcggggcgcgtcggcgtgcggcggggcggccgcgcccgcgggccccgggcgcgggggcgcggcgggccgggctccggccagccccggcacggccgccaggtcgccgtcgaagccctccgccagcgcctccaggatcccgcggcaggcggccaggcactccacggccacgcggcccgcctccgcgcgccggccgccgccaccaccgccggcgccgtcgtcgtcgtcgtcgtcgtcggccccggccggcgcggaggcgggcgcggcgctcaggcgccccagggcggcgagcacccccgcggcgccgtagccggcgggcaccgcgcgctcgtcggccggcgacgccgccgccgacggcaacggggcggcggcggcggcgggcttcccgcgggcgtcgtcgccgtcgtggcggttggcgtcgccgccgtcgtcgggggttcgcgccccggtcagcgccgcgttctcgcgcgccagcaggggcgcgtaggcgcggcgcaggctggtcagcaggaagcccttctgcgcgcggtcgtagcggcggctcatggccacggcggccgccacgtgcgccaggccccagccgaagcggcccgccgccatggcgtaccccaggtggggcacggcccgcgccacgctgccggagatgaaggagctgctgttgcgcgccgcgcccgagatccggaagcaggcctggtccagcgccacgtccccgggcgccacgcgcgggttctggagccaccccatcgcctccgcgtccggcgtgtacagcagccgcgtgatcagggcgtactgctgcgccgcgtcgcccagctcgggcgcccacacgggcgccggggcgcccgaggcctcgaaccgggcccgcgcctcctccgcctcgggcgccccccagaggccggggcggctgtcgcccagcccgccgtacagcacgcgccccgggggcggggggccggccccgggccacggctccccgctgacgtacccgtcgcggtagcgcgcgtagaaggcgccggaggccgcgtcggcgtccagctcgacccgccggggccgcccggccgtgaagcggcccgtggcgtcgcggccggccaccgccgcgcgggcccggcggcgctccaggcggcccgcggtcgccgcgggggtccgggccggggcgggctcggccctgggcgggctcggccggggcgccgcccccggggccctcgcgggcacccccgcctcctcgtcgtccgcgccgagggtcccgcccgcggcgtggtctgcggcgctggcgggggcgcgggcggcgtcgtcgtcgtcgtcgtcgtcagacgaggaggcggatgcagacgaggaggaggaggcggaggaggaggcggaggacgccgacgacgaggatccggattttgatgagtcagaggcggccgagcgccggcggggggcgcgccggcggcggtggtggtggtggtggtggtgtcggcggggcgccgggggtcgcggcgacaggctggccatggggtccgggtacgccccgcggaccgcggacgtcgtctccggtccgcggacccagcggcccgcgtcgcggtcgtcgtcatcgtcgtcgtcgtcgtcgtcgtcgttctcctcgccataatcggcgcgcatggagggggtccgcggcggagaaggcgagcgggccgcttcttcttccgcgccgtcgcgctccggggggggcgacgggatcgtgcgaacggcctcgtccaccatcgaggccagcagggccagctgccgcggcgagacgacgccgtccgcggcaggctcgtcgacggcctccccggacgccggggccgcctcgtcggcatcggcatcggcggcggcgtcgtcggcctcgtcttcgttctcctccggcccaccgtgccacccgaacccgggccgcgcggcggggcgacggtccgggttcggggtgggcggcggtccgtcggctggatccggagatccggggccgccggtcgtctccgccgcggcccggagacgtcccccgtcctcgtccgccatcgcgacctcggccccgcggccctgcgtcgtcgtcgtcgtcttcttcttcttccgctgctccgccgacatcgcctccgaccggggtgtgcgggggggggtcttcttcttcttcttcaggggcggcagtgggggggggtggttggcagtctctctcccccccgtgcggtgcgtgcgtgtgcctgtgtcttttcgcctctccgcgccgatcgggtagatcctggcggccgcgtcggtagccgcgctccgtgtggacgatcgccccgtcgcctggctgatatagtcctcggggcgcgcggggcggggggaaaggaggaggacgcggaggaggagcgatcgacgccgccgcgccccggctcgccggggttccgcccccaggtggaaccgcattatgcgcggccccgccccgacgcccgcgcgtccgcgtccgtggcggcggcccgttggtcgcgccgccgccggctccgcccgcgcggcatctcattagcgcccggcgcgggcggcttccgcttccgcccgcgatgctaatgagaccctcgtcgcgggcgggctcgctcccctgcccttccgggttcgtggtaatgagatgccggccccgcgctcccgttggcccccgccggccccaaaggggccggcgaggtcgccccgttggtccgcgggcggctccgccccaaagggggcggggccgcagggtaaaagaagtgagaacgcgaagcgttcgcacttcgtcctaatagtatatatattattagggcaaagtgcgagcgctggcgccctgcccggggcccgcgtcatcccgcgggctccgccccaaagggggcggggccgcagggtaaaagaagtgagaacgcgaagcgttcgcacttcgtcctaatagtatatatattattagggcaaagtgcgagcactggcgccctgcccggggcccgcgtcatcccgcgggctccgccccgaggcgggcccggacggggggcgggccgttcctcgcgcacataaagggccggcgtcccggtcgccgccgcaccaggggcacaccggctgcgcggcggagaccgggacggcagcggcggcatcgcgaagggggccacagcgagacagagacgccggcggcgagcggggcaccgacgcacccggatcggatcggatacagagacgcgggcgcatcggttccttttcgttctgcctttccctcccccccccccccccaccctgtacgtaccgcgaggacccatccacccactgcagccttatcgcaggtacggtgacccggggggccgggccggggggacgggccggggggacgggccggggggacgggccggggggacgggccggggggacgggccggggggacgggccggggggacgggccggggggacgggccggggggccggggggccggggggccggggggacggggggacgggccggggggacgggccggggggccggggggacggggggacggggggacggggggacggggggacggggggacggggggacggggggacggggggacggggggacggggggacggggggacggggggacggggggacggggggacgggccggggggacggggggacgggccggggggacggggggacggggccccgatcccaacatccgcgctttctcgcaggccgggcgccgccttcgtggacgggacaccggtgtggtaactggcgacaaggcgttgccactatggcagacatccccccggacccgcccgcgctcaacacgacgcctgcgaatcatgctcccccatccccacccccgggttcacggaagcgcagacgccccgtcctccccagctcgtcggaatctgagggtaagcccgacacagaatcggaatcctcctcgaccgagtcgtccgaggatgaggcgggagacctacgcggcgggcgccgtcgctccccgcgggagctcggggggaggtattttttggatctgtcggcagaatcgaccacggggacggaatcggagggaacggggccgtcggacgacgatgatgatgatgcgtcagacggctggttggttgacacacccccccgcaaatccaagcgaccccgaatcaacctgcgattaacgagctcccccgaccggcgtgcgggtgtggttttccccgaggtgtggagaagcgacagacctatccgcgcggcgcaaccccaggccccggcccagtcttccggggatcgcgcagccgcaccgcggcgctctgctcgccaggcccagatgcggagcggagccgcctggacgcttgatctgcattacatacgccagtgcgtcaaccagctctttcggatcctgcgtgccgccccgaacccgcccggcagcgccaaccgcctgcgccacctggtgcgagactgctacctcatgggctactgccggacccgcctggggccgcgcacgtggggccgcctgctgcagatctcgggcggaacctgggacgtgcgcctgcgaaacgcaatccgggaggtcgaggcgcattttgaacccgccgccgagcccgtgtgcgagctgccctgtctgaacgccaggcgttacggccccgagtgtgatgttggcaatctcgagaccaacggcggctcgacgagcgatgatgagatatcggatgcgacggactcggacgataccctcgcgtcccattccgacacggagggggggccctccccggccggccgggagaacccggaatccgcgtccggcggggctatcgcggctcggctggagtgtgagtttgggacgtttgactggacgtccgaggagggctcccagccctggctgtccgcggtggtcgccgataccagctccgccgaacgctctggcctacccgccccgggcgcgtgtcgcgcaacggaagccccagaacgcgaggacgggtgccgaaaaatgcgcttccccgccgcctgcccctatccctgcggccacacatttctccggccatgagcgcgggacccccagcccggtgtgtttgccaaacgaaaaataaacgccctacaagaaagcttttgtgtctgagtgtctggtttttctgggggtggaggaaggaacgacaaaaaaaagaaacaaacgcgacaccgctcgtacgtgtaatggggcgcagtgttttttattagcatcggggggggttagaggttggtgattggatagcaaacgtgggatgacggaggccactcgtcgccaacggccagcgggggcccggggttctgggggtcatcgtcccccgtctgccaggagggctcatcgggaatctcgggtcgccccatgcacgtaaaacacgggcgctgcgtggggtgggtcgccggatgcgggcgggatgatgcggggcggggtttgttgtgaggagccacgagggaccgtagccagcgaagacagctgcgttcccggtcgccgggcaccaccacgccgtattggtattcgtatcggctaaggagattttccagggggtgattaggcgctgcggggaacggggtccacgacacggtccgctcgggcaaaaaccgatcgggcaggggccacggttcccccacccacgcgtcgttggtcttcgtggcgatgaagcgaaaccccagccgggttttttgtgcgtactcgaaaaacggcacacacaggtccgccgccccgaccacccacaggtggtatagccggtgggggccggggcgctcttgatgcaggagccgaaaacacgcaggggcatccagaatctcgatgctttccagggggtcgtcctccgcaaacaggcccgtcgtggtgtttgggggacagcgacaggagcgggttcgcacgatcggtcgggtgaatttgggcaagtccatcagaggctcggccagcctgcgaaggttcgccgggcgaaccaccaccggggttcccagaggctcggaggccaggatccggcattgccgaagcagaaaactccacagagccgggcttgcgtcagcggaagtccgcggcagggcgtttcgttggtctaggagggtaaccacacttacaacaacaacgcccatgtcggtatattaggcccgtggtccgatcttcactcactcgcctgtctgcggacctatgcacggcgggacggcgcgcggacccgggggggctgcttgctatcacacggcccgttcgcacgttcgattttttcagccttgtttggttggctaggtatcccggataatctgacgttccggatatagggggcggggggtagtggggggtgtgtcgacaaactgccgcttcttaaaacaccggggcccgtcgctcggggtgctcgttggttggcacgcgcgacgcggcaaatggcctgtcgtaagttctgtggggtctaccgtagacccgacaagagacaggaggcgtccgtcccgccggagacaaacacggccccggccttcccggcgagcaccttttatacccccgcggaggatgcgtacctggcccccgggcccccggaaaccatccacccttcccgcccaccgtcccccggcgaggctgcgcgcctgtgtcagctgcaggagatcttggcccagatgcacagcgacgaggactaccccatcgtggacgccgcgggtgcggaggaggaagacgaggccgacgatgacgccccggatgacgtggcctacccggaggactacgcggaggggcgttttctgtccatggtttcggccgcccccctgcccggagccagcggccatcctcctgttccgggccgcgcagccccccccgacgtccggacctgcgacagcggtaaggtgggggccacggggttcaccccggaagagctcgacaccatggaccgggaggcacttcgggccatcagccgcgggtgcaagcccccttcgaccctggcaaaactggtgaccgggctgggattcgcgatccacggagcgctcatcccggggtcggaggggtgtgtctttgatagcagccacccgaactaccctcatcgggtaatcgtcaaggcggggtggtacgccagcacgagccacgaggcgcggctgctgagacgcctgaaccaccccgcgatcctacccctcctggacctgcacgtcgtttctggggtcacgtgtctggtcctccccaagtatcactgcgacctgtatacctatctgagcaagcgcccgtctccgttgggccacctacagataaccgcggtctcccggcagctcttgagcgccatcgactacgtccactgcgaaggcatcatccaccgcgatattaagaccgagaacatcttcatcaacacccccgagaacatctgtctgggggactttggggcggcgtgctttgtgcgcgggtgtcgatcgagccccttccattacgggatcgcaggcaccatcgatacaaacgcccccgaggtcctggccggggatccgtacacccaggtaatcgacatctggagcgccggcctggtgatctttgagaccgccgtccacaccgcgtccttgttctcggccccgcgcgaccccgaaaggcggccgtgcgacaaccagatcgcgcgcatcatccgacaggcccaggtacacgtcgacgagtttccgacgcacgcggaatcgcgcctcaccgcgcactaccgctcgcgggcggccgggaacaatcgtccggcgtggacccgaccggcgtggacccgctactacaagatccacacagacgtcgaatatctcatatgcaaagcccttacctttgacgcggcgctccgcccaagcgccgcggagttgctgcgcctgccgctatttcaccctaagtgaccccgctccccccggggggcgtggaggggggggctggttggatgtttttgcacaaaaagacgcggccctcgggctttggtgtttttggcaccttgccgcccggcgtcatgcacgccatcgctcccaggttgcttcttctttttgttctttctggtcttccggggacacgcggcgggtcgggtgtccccggaccaattaatccccccaacagcgatgttgttttcccgggaggttcccccgtggctcaatattgttatgcctatccccggttggacgatcccgggcccttgggttccgcggacgccgggcggcaagacctgccccggcgcgtcgtccgtcacgagcccctgggccgctcgttcctcacgggggggctggttttgctggcgccgccggtacgcggatttggcgcacccaacgcaacgtatgcggcccgtgtgacgtactaccggctcacccgcgcctgccgtcagcccatcctccttcggcagtatggagggtgtcgcggcggcgagccgccgtccccaaagacgtgcgggtcgtacacgtacacgtaccagggcggcgggcctccgacccggtacgctctcgtaaatgcttccctgctggtgccgatctgggaccgcgccgcggagacattcgagtaccagatcgaactcggcggcgagctgcacgtgggtctgttgtgggtagaggtgggcggggagggccccggccccaccgcccccccacaggcggcgcgtgcggagggcggcccgtgcgtccccccggtccccgcgggccgcccgtggcgctcggtgcccccggtatggtattccgcccccaaccccgggtttcgtggcctgcgtttccgggagcgctgtctgcccccacagacgcccgccgcccccagcgacctaccacgcgtcgcttttgctccccagagcctgctggtggggattacgggccgcacgtttattcggatggcacgacccacggaagacgtcggggtcctgccgccccattgggcccccggggccctagatgacggtccgtacgcccccttcccaccccgcccgcggtttcgacgcgccctgcggacagaccccgagggggtcgaccccgacgttcgggccccccgaaccgggcggcgcctcatggccttgaccgaggacacgtcctccgattcgcctacgtccgctccggagaagacgcccctccctgtgtcggccaccgccatggcaccctcagtcgacccaagcgcggaaccgaccgcccccgcaaccactactccccccgacgagatggccacacaagccgcaacggtcgccgttacgccggaggaaacggcagtcgcctccccgcccgcgactgcatccgtggagtcgtcgccactccccgccgcggcggcggcaacgcccggggccgggcacacgaacaccagcagcgcctccgcagcgaaaacgccccccaccacaccagcccccacgacccccccgcccacgtctacccacgcgaccccccgccccacgactccggggccccaaacaacccctcccggacccgcaaccccgggtccggtgggcgcctccgccgcgcccacggccgattcccccctcaccgcctcgccccccgctaccgcgccggggccctcggccgccaacgtttcggtcgccgcgaccaccgccacgcccggaacccggggcaccgcccgtacccccccaacggacccaaagacgcacccacacggacccgcggacgctccccccggctcgccagcccccccaccccccgaacatcgcggcggacccgaggagtttgagggcgccggggacggcgaaccccccgaggacgacgacagcgccaccggcctcgccttccgaactccgaaccccaacaaaccaccccccgcgcgccccgggcccatccgccccacgctcccgccaggaattcttgggccgctcgcccccaacacgcctcgcccccccgcccaagctcccgctaaggacatgccctcgggccccacaccccaacacatccccctgttctggttcctaacggcctcccctgctctagatatcctctttatcatcagcaccaccatccacacggcggcgttcgtttgtctggtcgccttggcagcacaactttggcgcggccgggcggggcgcaggcgatacgcgcacccgagcgtgcgttacgtatgtctgccacccgagcgggattagggggtgggggtggggggcgagaaacgatgaaggacgggaaagggaacagcgaccaaatgtcacgataagaacaataaacctgtgacgtcaatcagatatgtgagtttggttgtgttttgtgggactgggggcggggggtgggaggtatcagtgggtgacagagtcttttaaaagacgtgtcccggggccctcgagacgcgcaacttttggccacacagagaaaggcccccagacgaagtcacccgggtccccgaacaaaaacaaaaaccttgaccgccgccggggggcgtgcctgttgttttggtctcaatggatcggtatgccgttcggacctgggggattgtgggaatcctcgggtgtgctgctgttggggccgcacccaccggccccgcgtccgatacaacaaacgcgaccgcacgcctccccacgcaccccccactcatccgttccgggggctttgccgtccccctcatcgtgggggggctgtgtctcatgattctggggatggcgtgtctactcgaggtcctgcgtcgcctgggtcgcgagttggcgaggtgctgcccccacgcgggccaatttgccccatgatttttcgcctttctggccttgcccccaccccatcgccccgattgtgtgtcgggtgcccggggtacagcagctatggagcggtcggtaatataactttggttgtcgccacacgccccgtgccgggcatgggttgtgcgggaaggacgaaataatccggcgatccccaagcgtaccaactgggggggggggggggaaaagaaactaaaaacacatcaagcccacaacccatcccacaatgggggttatggcggacccaccgcaccaccatactccgattcgaccacatatgcaaccaaatcacccccagaggggaggttccatttttacgaggaggaggagtataatagagtctttgtgtttaaaacccggggtcggtgtggtgttcggtcataagctgcattgcgaacgactagtcgccgtttttcgtgtgcatcgcgtatcacggcatggggcgtttgacctccggcgtcgggacggcggccctgctagttgtcgcggtgggactccgcgtcgtctgcgccaaatacgccttagcagacccctcgcttaagatggccgatcccaatcgatttcgcgggaagaaccttccggttttggaccagctgaccgacccccccggggtgaagcgtgtttaccacattcagccgagcctggaggacccgttccagccccccagcatcccgatcactgtgtactacgcagtgctggaacgtgcctgccgcagcgtgctcctacatgccccatcggaggccccccagatcgtgcgcggggcttcggacgaggcccgaaagcacacgtacaacctgaccatcgcctggtatcgcatgggagacaattgcgctatccccatcacggttatggaatacaccgagtgcccctacaacaagtcgttgggggtctgccccatccgaacgcagccccgctggagctactatgacagctttagcgccgtcagcgaggataacctgggattcctgatgcacgcccccgccttcgagaccgcgggtacgtacctgcggctagtgaagataaacgactggacggagatcacacaatttatcctggagcaccgggcccgcgcctcctgcaagtacgctctccccctgcgcatccccccggcagcgtgcctcacctcgaaggcctaccaacagggcgtgacggtcgacagcatcgggatgctaccccgctttatccccgaaaaccagcgcaccgtcgccctatacagcttaaaaatcgccgggtggcacggccccaagcccccgtacaccagcaccctgctgccgccggagctgtccgacaccaccaacgccacgcaacccgaactcgttccggaagaccccgaggactcggccctcttagaggatcccgccgggacggtgtcttcgcagatccccccaaactggcacatcccgtcgatccaggacgtcgcgccgcaccacgcccccgccgcccccagcaacccgggcctgatcatcggcgcgctggccggcagtaccctggcggtgctggtcatcggcggtattgcgttttgggtacgccgccgcgctcagatggcccccaagcgcctacgtctcccccacatccgggatgacgacgcgcccccctcgcaccagccattgttttactagaggagtttccccgctcccgtgtacctctgggcccgtgtgggagggtggctggggtatttgggtgggacttggactccgcataaagggagtctcgaaggagggaaactaggacagttcataggccgggagcgtggggcgcgcaccgctgtcccgacgattagccaccgcgcccacagccacctcgacccgtccgatcccggtatgcccggccgctcgctgcagggcctggcgatcctgggcctgtgggtctgcgccaccggcctggtcgtccgcggccccacggtcagtctggtctcagactcactcgtggatgccggggccgtggggccccagggcttcgtggaagaggacctgcgtgttttcggggagcttcattttgtgggggcccaggtcccccacacaaactactacgacggcatcatcgagctgtttcactaccccctggggaaccactgcccccgcgttgtacacgtggtcacactgaccgcatgcccccgccgccccgccgtggcgttcaccttgtgtcgctcgacgcaccacgcccacagccccgcctatccgaccctggagctgggtctggcgcggcagccgcttctgcgggttcgaacggcaacgcgcgactatgccggtctgtatgtcctgcgcgtatgggtcggcagcgcgacgaacgccagccggtttgttttgggggtggcgctctctgccaacgggacgtttgtgtataacggctcggactacggctcctgcgatccggcgcagcttcccttttcggccccgcgcctgggaccctcgagcgtatacacccccggagcctcccgacccacccctccacggacaacgacacccccgtcctccccccgagacccgacccccgcccccggggacacagggacgcccgcgcccgcgagcggcgagatagccccgcccaattccacgcgatcggccagcgaatcgagacacaggctaaccgtagcccaggtaatccagatcgccataccggcgtccatcatcgcctttgtgtttctgggcagctgtatctgcttcatccatagatgccagcgccgatacaggcgcccccgcggccagatttacaaccccgggggcgtttcctgcgcggtcaacgaggcggccatggcccgcctcggagccgagctgcgatcccacccaaacaccccccccaaaccccgacgccgttcgtcgtcgtccacgaccatgccttccctaacgtcgatagctgaggaatcggagccaggtccagtcgtgctgctgtccgtcagtcctcggccccgcagtggcccgacggccccccaagaggtctaggtccaagcgggccgttcggcaggcccgccccaccgcccccatcgtggttatttccccccccccccaataaaccgatgttatttgcctatatgcgtgtgttggatccctttgtgatcgttcgtcattccccggatggcatgggaggcgggtaatggatgggcggggcccgggggggaggaaaaagaataaagggggtagtgtcggagaggcccgccgcgcatttaaggagtcgccgccccgactctgtgtcttcgggtgacttggtgcgccgccgtcagctagtctccgatctgccccgaccgacggctcctgccacccgaacatggctcgcggggccgggttggtgttttttgttggagtttgggtcgtatcgtgcctggcggcagcacccagaacgtcctggaaacgggtaacctcgggcgaggacgtggtgttgcttccggcgcccgcggaacgcacccgggcccacaaactactgtgggccgcggaacccctggatgcctgcggtcccctgcgcccgtcgtgggtggcgctgtggcccccccgacgggtgctcgagacggtcgtggatgcggcgtgcatgcgcgccccggaaccgctcgccatagcatacagtcccccgttccccgcgggcgacgagggactgtattcggagttggcgtggcgcgatcgcgtagccgtggtcaacgagagtctggtcatctacggggccctggagacggacagcggtctgtacaccctgtccgtggtcggcctaagcgacgaggcgcgccaagtggcgtcggtggttctggtcgtggagcccgcccctgtgccgaccccgacccccgacgactacgacgaagaagacgacgcgggcgtgagcgaacgcacgccggtcagcgttccccccccaacccccccccgtcgtccccccgtcgcccccccgacgcaccctcgtgttatccccgaggtgtcccacgtgcgcggggtaacggtccatatggagaccccggaggccattctgtttgcccccggggagacgtttgggacgaacgtctccatccacgccattgcccacgacgacggtccgtacgccatggacgtcgtctggatgcggtttgacgtgccgtcctcgtgcgccgagatgcggatctacgaagcttgtctgtatcacccgcagcttccagagtgtctatctccggccgacgcgccgtgcgccgtaagttcctgggcgtaccgcctggcggtccgcagctacgccggctgttccaggactacgcccccgccgcgatgttttgccgaggctcgcatggaaccggtcccggggttggcgtggctggcctccaccgtcaatctggaattccagcacgcctccccccagcacgccggcctctacctgtgcgtggtgtacgtggacgatcatatccacgcctggggccacatgaccatcagcaccgcggcgcagtaccggaacgcggtggtggaacagcacctcccccagcgccagcccgagcccgtcgagcccacccgcccgcacgtgagagccccccatcccgcgccctccgcgcgcggcccgctgcgcctcggggcggtgctgggggcggccctgttgctggccgccctcgggctgtccgcgtgggcgtgcatgacctgctggcgcaggcgctcctggcgggcggttaaaagccgggcctcggcgacgggccccacttacattcgcgtggcggacagcgagctgtacgcggactggagttcggacagcgagggggagcgcgacgggtccctgtggcaggaccctccggagagacccgactctccctccacaaatggatccggctttgagatcttatcaccaacggctccgtctgtatacccccatagcgaggggcgtaaatctcgccgcccgctcaccacctttggttcgggaagcccgggccgtcgtcactcccaggcctcctatccgtccgtcctctggtaaggcgtcttccgacgacgcggacgtcggcgatgaactgattgccatcgcggacgcacgcggggacccgccagagaccctgccccccggcgcgggcggcgccgcgcccgcgtgccgcagaccacctcgcggcggctcccccgcggcctttcccgtggccctccacgccgtggacgccccctcccaattcgtcacctggctcgccgtgcgctggctgcggggggcggtgggtctcggggccgtcctgtgcgggattgcgttttacgtgacgtcaatcgcccgaggcgcataaaggtccggcggccagccccgccgcagctcataaaaatcgtgagtcacggcaaccgcaccttcgcctccggccctccgccagcgcccttccgcgtccgcgatgacctcccggcccgccgaccaagactcggtgcgttccagcgcgtcggtgccgctttaccccgcggcctcgcccgtcccggcagaagcctactactcggaaagcgaagacgaggccgccaacgacttcctcgtgcgcatgggccgccagcagtcggtcctaaggcgccgacggcggcgcacgcggtgcgtcgggctggttatcgcctgtctcgtcgtggccctcctatctggagggttcggggcacttttggtgtggctgctccgctaaatgacgcctcgatgtatggcgccttcttcgcccccacccctcgccgcgacccacgtccgtatgttaattgcaataaagtggttgattgtcattacggtctactaggttgtcttttttttttgggggggggggaggaaatgcagaaaagggtaagaaattctcggaatttcacccccgggggggggcaagtgcagtaacccagttcctcagtgtttgggaaatctattgaactctcccggctcctccgtgttagggaagtctcttggggaaatctattgacctctcgccccccccccccaggaggggggcagtgcagtaccccagttcctccgtgctggggaaatctctctgccgggtacgggctccagacgaaggacccatacatttccccatccgcaccccacatctggcgttctagagtcacgacgcatttgcccccgtccccgcagcaacacacaaagcgatttcaattttcacgattttattattaattacaccaaccaccctgtccccgggacgtggtcaggaccgggggtccgcacccaaacgcacgaaacaaatgctggcagtgtgccgaatataaccccgcgtaggaacacgtcgacgcgtgcgccaaacagcaccagaaggcgcatgccatcagcaggtcgtgcatatggcgatgtgtttggacgcagggcgcagccgcggcgataaaattcatggcggccgtccgccagggccacagcggcgaggactccctgttggcccgaagccattgggtatgaaccagctgcgcctcctgtccgaccctggctcccgccagcgggggcggtgggtcgtgggtgttgagagcacacaggcgggacacctcgatcaccgtccgaaaaaaggcccggtggtccgcgggcagcatctgcaggtgcgccagggcctgggcgttgagagggtacaactcggagccgggggactccgggggccggtccgcgcggtgccgcgagttggcacgctttggggcccgggtgtcggacgcgggcgcgttatggatcccgacgcggggcagaacgtacgtgcgttggcgcggcgatgaggggtccgggctgccgaggggggcgtaggggaccgggctaggcaagcccgcgggttgcgcggggttcccgtgggggtctaggctccctgggcacccgtgggggtcgtgggggtcgcgggtccctgggtatgcgcgggaccctgggttctctgggagatcgtggaactcgcggttccctgggctctcggggaacccggggctccctggggacacgtggtgccctgggaattcttgatggtcggacggcttcagatggcttcgggatcgagagggccgcacagactcgtagtagacccgaatctccacgtttccccgccgccggatcatggtcgccgccccggtgcgggggcccgtcggtcggaagcgagtgcccttcaagcgtgtccgctcctctgggctgcatgccgtcggatggggtgccttttaaggaaaggtctcggctgcccgccccaaccggggtttgggggtgggccggggaaaccccggatgccatgggggggtcacaccctaagcgccggcgcgctggttgggtgggggtagaggggagtccccggtcgacgagatcgtataagctgggtaccgagctcgaattcatcgatgatatcagatcgatccccatggtgtcccgtccacgaaggcggcgcccggcctgcgagaaagcgcggatgttgggatcggggccccgtccccccgttccccggcccgtccccccgtccccccggcccgtccccccggcccgtccccccggcccggccccccgggtcaccgtacctgcgataaggctgcagtgggtggatgggtcctcgcggtacgtacagggtgggggggggggggggagggaaaggcagaacgaaaaggaaccgatgcgcccgcgtctctgtatccgatccgatccgggtgcgtcggtgccccgctcgccgccggcgtctctgtctcgctgtggcccccttcgcgatgccgccgctgccgtcccggtctccgccgcgcagccggtgtgcccctggtgcggcggcgaccgggacgccggccctttatgtgcgcgaggaacggcccgccccccgtccgggcccgcctcggggcggagcccgcgggatgacgcgggccccgggcagggcgccagtgctcgcactttgccctaataatatatatactattaggacgaagtgcgaacgcttcgcgttctcacttcttttaccctgcggccccgccccctttggggcggagcccgcgggatgacgcgggccccgggcagggcgccagcgctcgcactttgccctaataatatatatactattaggacgaagtgcgaacgcttcgcgttctcacttcttttaccctgcggccccgccccctttggggcggagccgcccgcggaccaacggggcgacctcgccggcccctttggggccggcgggggccaacgggagcgcggggccggcatctcattaccacgaacccggaagggcaggggagcgagcccgcccgcgacgagggtctcattagcatcgcgggcggaagcggaagccgcccgcgccgggcgctaatgagatgccgcgcgggcggagccggcggcggcgcgaccaacgggccgccgccacggacgcggacgcgcgggcgtcggggcggggccgcgcataatgcggttccacctgggggcggaaccccggcgagccggggcgcggcggcgtcgatcgctcctcctccgcgtcctcctcctttccccccgccccgcgcgccccgaggactatatcagccaggcgacggggcgatcgtccacacggagcgcggctaccgacgcggccgccaggatctacccgatcggcgcggagaggcgaaaagacacaggcacacgcacgcaccgcacgggggggagagagactgccaaccacccccccccactgccgcccctgaagaagaagaagaagacccccccccgcacaccccggtcggaggcgatgtcggcggagcagcggaagaagaagaagacgacgacgacgacgcagggccgcggggccgaggtcgcgatggcggacgaggacgggggacgtctccgggccgcggcggagacgaccggcggccccggatctccggatccagccgacggaccgccgcccaccccgaacccggaccgtcgccccgccgcgcggcccgggttcgggtggcacggtgggccggaggagaacgaagacgaggccgacgacgccgccgccgatgccgatgccgacgaggcggccccggcgtccggggaggccgtcgacgagcctgccgcggacggcgtcgtctcgccgcggcagctggccctgctggcctcgatggtggacgaggccgttcgcacgatcccgtcgccccccccggagcgcgacggcgcggaagaagaagcggcccgctcgccttctccgccgcggaccccctccatgcgcgccgattatggcgaggagaacgacgacgacgacgacgacgacgatgacgacgaccgcgacgcgggccgctgggtccgcggaccggagacgacgtccgcggtccgcggggcgtacccggaccccatggccagcctgtcgccgcgacccccggcgccccgccgacaccaccaccaccaccaccaccgccgccggcgcgccccccgccggcgctcggccgcctctgactcatcaaaatccggatcctcgtcgtcggcgtcctccgcctcctcctccgcctcctcctcctcgtctgcatccgcctcctcgtctgacgacgacgacgacgacgacgccgcccgcgcccccgccagcgccgcagaccacgccgcgggcgggaccctcggcgcggacgacgaggaggcgggggtgcccgcgagggccccgggggcggcgccccggccgagcccgcccagggccgagcccgccccggcccggacccccgcggcgaccgcgggccgcctggagcgccgccgggcccgcgcggcggtggccggccgcgacgccacgggccgcttcacggccgggcggccccggcgggtcgagctggacgccgacgcggcctccggcgccttctacgcgcgctaccgcgacgggtacgtcagcggggagccgtggcccggggccggccccccgcccccggggcgcgtgctgtacggcgggctgggcgacagccgccccggcctctggggggcgcccgaggcggaggaggcgcgggcccggttcgaggcctcgggcgccccggcgcccgtgtgggcgcccgagctgggcgacgcggcgcagcagtacgccctgatcacgcggctgctgtacacgccggacgcggaggcgatggggtggctccagaacccgcgcgtggcgcccggggacgtggcgctggaccaggcctgcttccggatctcgggcgcggcgcgcaacagcagctccttcatctccggcagcgtggcgcgggccgtgccccacctggggtacgccatggcggcgggccgcttcggctggggcctggcgcacgtggcggccgccgtggccatgagccgccgctacgaccgcgcgcagaagggcttcctgctgaccagcctgcgccgcgcctacgcgcccctgctggcgcgcgagaacgcggcgctgaccggggcgcgaacccccgacgacggcggcgacgccaaccgccacgacggcgacgacgcccgcgggaagcccgccgccgccgccgccccgttgccgtcggcggcggcgtcgccggccgacgagcgcgcggtgcccgccggctacggcgccgcgggggtgctcgccgccctggggcgcctgagcgccgcgcccgcctccgcgccggccggggccgacgacgacgacgacgacgacggcgccggcggtggtggcggcggccggcgcgcggaggcgggccgcgtggccgtggagtgcctggccgcctgccgcgggatcctggaggcgctggcggagggcttcgacggcgacctggcggccgtgccggggctggccggagcccggcccgccgcgcccccgcgcccggggcccgcgggcgcggccgccccgccgcacgccgacgcgccccgcctgcgcgcctggctgcgcgagctgcggttcgtgcgcgacgcgctggtgctgatgcgcctgcgcggggacctgcgcgtggccggcggcagcgaggccgccgtggccgccgtgcgcgccgtgagcctggtcgccggggccctgggcccggcgctgccgcggagcccgcgcctgctgagctccgccgccgccgccgccgcggacctgctcttccagaaccagagcctgcgccccctgctggccgacaccgtcgccgcggccgactcgctcgccgcgcccgcctccgcgccgcgggaggcgcgcaagcgcaagagccccgccccggccagggcgccgccgggcggcgccccgcgccccccgaagaagagccgcgcggacgccccccgccccgcggccgcccctcccgcgggggccgcgccccccgccccgccgacgccgccgccgcggccgccgcgccccgcggcgctgacccgccggcccgccgagggccccgacccgcagggcggctggcgccgccagccgccggggcccagccacacgccggcgccctcggccgccgccctggaggcctactgcgccccgcgggccgtggccgagctcacggaccacccgctcttccccgcgccgtggcgcccggccctcatgttcgacccgcgcgcgctggcctcgctggccgcgcgctgcgccgccccgccccccggcggcgcgcccgccgccttcggcccgctgcgcgcctcgggcccgctgcgccgcgcggcggcctggatgcgccaggtgcccgacccggaggacgtgcgcgtggtgatcctctactcgccgctgccgggcgaggacctggccgcgggccgcgccgggggcgggccccccccggagtggtccgccgagcgcggcgggctgtcctgcctgctggcggccctgggcaaccggctctgcgggcccgccacggccgcctgggcgggcaactggaccggcgcccccgacgtctcggcgctgggcgcgcagggcgtgctgctgctgtccacgcgggacctggccttcgccggcgccgtggagttcctggggctgctggccggcgcctgcgaccgccgcctcatcgtcgtcaacgccgtgcgcgccgcggactggcccgccgacgggcccgtggtctcgcggcagcacgcctacctggcctgcgaggtgctgcccgccgtgcagtgcgccgtgcgctggccggcggcgcgggacctgcgccgcaccgtgctggcctccggccgcgtgttcgggccgggggtcttcgcgcgcgtggaggccgcgcacgcgcgcctgtaccccgacgcgccgccgctgcgcctctgccgcggggccaacgtgcggtaccgcgtgcgcacgcgcttcggccccgacacgctggtgcccatgtccccgcgcgagtaccgccgcgccgtgctcccggcgctggacggccgggccgccgcctcgggcgcgggcgacgccatggcgcccggcgcgccggacttctgcgaggacgaggcgcactcgcaccgcgcctgcgcgcgctggggcctgggcgcgccgctgcggcccgtctacgtggcgctggggcgcgacgccgtgcgcggcggcccggcggagctgcgcgggccgcggcgggagttctgcgcgcgggcgctgctcgagcccgacggcgacgcgcccccgctggtgctgcgcgacgacgcggacgcgggcccgcccccgcagatacgctgggcgtcggccgcgggccgcgcggggacggtgctggccgcggcgggcggcggcgtggaggtggtggggaccgccgcggggctggccacgccgccgaggcgcgagcccgtggacatggacgcggagctggaggacgacgacgacggactgtttggggagtgacgggggggaaacttccgggagcgggggaggggggagatggggagagggggaaggaatcgggcgtctgtgcgcctttaagacagacgcggcgatggccgcgcgcgtgtgtgagaaataaagaacgagacagacgaaaacgtaccgccttgtgtggtttattcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggcgggcgggggtcgggtgggcggcacgtctcccgcgcccgcggggggtctggggctctgacctgagtgcaggttacgaaggtcaggtggcccgagcccccccgcaggagcgggagggaaggcacggggcgcgggagggaggggctgctgcgagctcggggccgcgggcgcggggggaggggcgggggaagcccccggggcggggcgcgggggaggcggccgcgggggaggcggccgcgggaccgcagccccgtggcgcgcgggggggaggggctgccgcgagctcggcgggatggaggggagggagggggtggcggggaaccgtgtgcgggcgggcgggtgcttggtgcaactgtctggtctgcgagggcgagcggtggtgcgactggcgtcttcgggggggcggggagcttgggagtgtgtggtggtctgcggcacagcctgctagtccccgtcttgccgcgcgggggcgggcgcgggaaaaaagccgcgcgggggcgcccgcgggaaggcagccccgcggcgcgcggggggaggggcggcgcccgcgggggagcggccggctccgggggagggacggggaagggggcgcgcggggctgccctgccgcccgcccgccgccgccgcccgccttcgcgcccccccccaaaaaacaccccccccgggggttgactccccgggggaaaagaggcggggcggg

What is claimed is:

1. A composition, comprising HSV2 viruses wherein the HSV2 viruses consist of oHSV2-hGM-CSF, oHSV2-OX40L, and oHSV2-BsAb, wherein (1) oHSV2-hGM-CSF is loaded with a gene encoding human granulocyte-macrophage colony stimulating factor, wherein human granulocyte-macrophage colony stimulating factor comprises SEQ ID No:8, (2) oHSV2-OX40L is loaded with a gene encoding OX40L protein, wherein OX40L protein comprises SEQ ID No:2 and (3) oHSV2-BsAb is loaded with a gene encoding a bispecific single-chain antibody, wherein bispecific single-chain antibody comprises a amino acid sequence of SEQ ID NO: 1.

2. The composition according to claim 1, wherein the nucleotide sequence of oHSV2-hGM-CSF is shown in SEQ ID NO: 23; the nucleotide sequence of oHSV2-OX40L is shown in SEQ ID NO: 17.

3. The composition according to claim 1, wherein the HSV2 viruses are herpes simplex virus type II HG52 strain, wherein ICP34.5 and ICP47 of the HG52 strain are eliminated; and the loaded genes are inserted into ICP 34.5 sites.

* * * * *